US009598701B2

(12) United States Patent
Damude et al.

(10) Patent No.: US 9,598,701 B2
(45) Date of Patent: Mar. 21, 2017

(54) DOWN-REGULATION OF GENE EXPRESSION USING ARTIFICIAL MICRORNAS FOR SILENCING FATTY ACID BIOSYNTHETIC GENES

(71) Applicant: E I DU PONT DE NEMOURS AND COMPANY, Wilmington, DE (US)

(72) Inventors: Howard Glenn Damude, Hockessin, DE (US); Brian McGonigle, Wilmington, DE (US)

(73) Assignee: E I DU PONT DE NEMOURS AND COMPANY, Wilmington, DE (US)

( * ) Notice: Subject to any disclaimer, the term of this patent is extended or adjusted under 35 U.S.C. 154(b) by 534 days.

(21) Appl. No.: 13/747,617

(22) Filed: Jan. 23, 2013

(65) Prior Publication Data

US 2013/0219565 A1    Aug. 22, 2013

Related U.S. Application Data

(60) Provisional application No. 61/589,682, filed on Jan. 23, 2012.

(51) Int. Cl.
*C12N 15/82* (2006.01)
*C12N 15/11* (2006.01)
*C12N 15/113* (2010.01)

(52) U.S. Cl.
CPC ...... *C12N 15/8247* (2013.01); *C12N 15/1137* (2013.01); *C12N 15/8218* (2013.01)

(58) Field of Classification Search
None
See application file for complete search history.

(56) References Cited

U.S. PATENT DOCUMENTS

| | | | |
|---|---|---|---|
| 8,049,062 B2 | 11/2011 | Damude et al. | |
| 8,927,809 B2 | 1/2015 | Meyer et al. | |
| 2005/0138689 A1 | 6/2005 | Aukerman | |
| 2006/0005276 A1* | 1/2006 | Falco et al. | 800/281 |
| 2008/0254191 A1* | 10/2008 | Damude et al. | 426/598 |
| 2009/0155910 A1* | 6/2009 | McGonigle | 435/419 |
| 2011/0067149 A1* | 3/2011 | Wagner | 800/312 |

FOREIGN PATENT DOCUMENTS

| | | |
|---|---|---|
| CN | 101565701 A | 10/2009 |
| WO | 2004/009779 A2 | 1/2004 |
| WO | WO 2004072259 A2 * | 8/2004 |
| WO | 2006/044322 A2 | 4/2006 |
| WO | 2006/073787 A2 | 7/2006 |
| WO | 2006/009659 A2 | 10/2006 |
| WO | 2008/100545 A2 | 8/2008 |
| WO | 2009/079532 A2 | 6/2009 |
| WO | 2009/79548 A2 | 6/2009 |
| WO | 2009/143397 A2 | 11/2009 |
| WO | 2010/114989 A1 | 10/2010 |
| WO | 2011/133387 A1 | 10/2011 |
| WO | 2012/027698 A1 | 3/2012 |
| WO | 2012/096562 A1 | 6/2013 |
| WO | 2013/112578 A1 | 8/2013 |

OTHER PUBLICATIONS

Flores et al (Silencing of GmFAD3 gene by siRNA leads to low a-linolenic acids (18:3) of fad3 mutant phenotype in soybean [*Glycine max* (Merr.)] Transgenic Res 17:839-850, 2008).*
Zhang et al (Plant microRNA: A small regulatory molecule with big impact. Developmental Biology 289, 3-16, 2006).*
Nguyen et al (Altering *Arabidopsis* Oilseed Composition by a Combined Antisense-Hairpin RNAi Gene Suppression Approach. Am Oil Chem Soc 86:41-49, 2009).*
Smith et al (Total silencing by intron-spliced hairpin RNAs. Nature, vol. 407, p. 319-320, Sep. 21, 2000).*
John Paul Alvarez et al., Endogenous and Synthetic MicroRNAs Stimulate Simultaneous, Efficient, and Localized Regulation of Multiple Targets in Diverse Species, The Plant Cell, May 2006, pp. 1134-1151, vol. 18.
David P. Bartel, MicroRNAs: Genomics, Biogenesis, Mechanism, and Function, Cell, Jan. 23, 2004, pp. 281-297, vol. 116.
Srinivas Belide et al., Modification of seed oil composition in *Arabidopsis* by artificial microRNA-mediated gene silencing, Frontiers in Plant Science, Jul. 31, 2012, pp. 1-6, Article 168.
Tobias Dezulian et al., Conservation and divergence ofmicroRNA families in plants, Genome Biology, 2005, 6:P13.
Matthew W. Jones-Rhoades et al., MicroRNAs and Their Regulatory Roles in Plants, Annu. Rev. Plant Biol. 2006, pp. 19-53, vol. 57.
Yukio Kurihara et al., *Arabidopsis* micro-RNA biogenesis through Dicer-like 1 protein functions, PNAS, Aug. 24, 2004, pp. 12753-12758, vol. 101, No. 34.
Zhongsen Li et al., Stacking Multiple Transgenes at a Selected Genomic Site via Repeated Recombinase-Mediated DNA Cassette Exchanges, Plant Physiology, Oct. 2010, pp. 622-631, Vo. 154.
Qing Liu et al., A new mechanism in plant engineering: The potential roles of microRNAs in molecular breeding for crop improvement, Biotechnology Advances, 2010, pp. 301-307, vol. 28 No. 3.
Allison C. Mallory et al., Functions of microRNAs and related small RNAs in plants, Nature Genetics, Jun. 2006, pp. S31-S36, vol. 38.
David H. Mathews et al., Expanded Sequence Dependence of Thermodynamic Parameters Improves Prediction of RNA Secondary Structure, J. Mol. Biol., 1999, pp. 911-940, vol. 288.
Qu-Wen Niu et al., Expression of artificial microRNAs in transgenic Arabidopsis thaliana confers virus resistance, Nature Biotechnology, Nov. 2006, pp. 1420-1428, vol. 24, No. 11.
Stephan Ossowski et al., Gene Silencing in plants using artificial microRNAs and other small RNAs, The Plant Journal, 2008, pp. 674-690.

(Continued)

*Primary Examiner* — Medina A Ibrahim
*Assistant Examiner* — Wayne Zhong

(57) ABSTRACT

Isolated nucleic acid fragments comprising precursor miR-NAs, and artificial miRNAs and their use in down-regulating gene expression of fatty acid biosynthetic genes are described.

20 Claims, No Drawings

(56) References Cited

OTHER PUBLICATIONS

Maria De La Luz Gutierrez-Nava et al., Artificial trnas-Acting siRNAs Confer Consistent and Effective Gene Silencing, Plant Physiology, Jun. 2008, pp. 543-551, vol. 147.
Eneida Abreu Parizotto et al, In vivo investigation of the transcription, processing, endonucleolytic activity, and functional relevance of the spatial distribution of a plant miRNA, Genes & Development, 2004, pp. 2237-2242, vol. 18.
Qi Peng et al., Simultaneous silencing of FAD2 and FAE1 genes affects both oleic acid and erucic acid contents in Brassica napus seeds, Plant Cell Reports, 2010, pp. 317-325, vol. 29.
Rebecca Schwab et al., Highly Specific Gene Silencing by Artificial MicroRNAs in *Arabidopsis*, The Plant Cell, May 2006, pp. 1121-1133, vol. 18.
Senthil Subramanian et al., Novel and nodulation-regulated microRNAs in soybean roots, BMC Genomics, 2008, pp. 1-14, vol. 9:160.
Michael Zuker, Mfold web server for nucleic acid folding and hybridization prediction, Nucleic Acids Research, 2003, pp. 3406-3415, vol. 31, No. 13.
International Search Report for PCT/US13/22654.
U.S. Appl. No. 13/295,345, filed Nov. 14, 2011, now U.S. Pat. No. 8,927,809.
Communication for EP Application No. 13703941.8, Dated Sep. 8, 2015.
International Search Report—PCT/US2014/048825—Mailed Jan. 9, 2015.
Anhony J Kinney, Enhancing Soybean Seeds for Industrial Applications, Mar. 8, 2013, Retrieved from the Internet: URL:http://22/agwest.sk.ca/kaizen/PBI02013/KinneyPB10213_web.pdf.

* cited by examiner

DOWN-REGULATION OF GENE EXPRESSION USING ARTIFICIAL MICRORNAS FOR SILENCING FATTY ACID BIOSYNTHETIC GENES This Application claims the benefit of U.S. Provisional Application No. 61/589,682, filed Jan. 23, 2012 which is hereby incorporated by reference in its entirety.

FIELD OF THE INVENTION

The field of the present invention relates, generally, to plant molecular biology. In particular, it relates to constructs and methods to down-regulate expression of fatty acid biosynthetic genes.

BACKGROUND

MicroRNAs (miRNAs) were first identified only a few years ago, but already it is clear that they play an important role in regulating gene activity. These 20-22 nucleotide noncoding RNAs have the ability to hybridize via base-pairing with specific target mRNAs and downregulate the expression of these transcripts, by mediating either RNA cleavage or translational repression.

Recent studies have indicated that miRNAs have important functions during development. In plants, they have been shown to control a variety of developmental processes including flowering time, leaf morphology, organ polarity, floral morphology, and root development (reviewed by Mallory and Vaucheret (2006) Nat Genet. 38: S31-36). Given the established regulatory role of miRNAs, it is likely that they are also involved in the control of some of the major crop traits such drought tolerance and disease resistance.

miRNAs are transcribed by RNA polymerase II as polyadenylated and capped messages known as pri-miRNAs. These pri-miRNAs are processed into smaller transcripts known as pre-miRNAs and these precursors have the ability to form stable hairpin structures (reviewed by Bartel (2004) Cell 116: 281-297; Jones-Rhoades M W, Bartel D P, Bartel B. MicroRNAS and their regulatory roles in plants. Annu Rev Plant Biol. 2006; 57:19-53.) While pri-miRNAs are processed to pre-miRNAs by Drosha in the nucleus and Dicer cleaves pre-miRNAs in the cytoplasm in metazoans, miRNA maturation in plants differs from the pathway in animals because plants lack a Drosha homolog. Instead, the RNase III enzyme DICER-LIKE 1 (DCL1), which is homologous to animal Dicer, may possess Drosha function in addition to its known function in hairpin processing (Kurihara and Watanabe (2004) Proc Natl Acad Sci 101: 12753-12758).

Artificial microRNAs (amiRNAs) have recently been described in *Arabidopsis* targeting viral mRNA sequences (Niu et al. (2006) *Nature Biotechnology* 24:1420-1428) or endogenous genes (Schwab et al. (2006) *Plant Cell* 18:1121-1133). The amiRNA construct can be expressed under different promoters in order to change the spatial pattern of silencing (Schwab et al. (2006) *Plant Cell* 18:1121-1133). Artificial miRNAs replace the microRNA and its complementary star sequence in a precursor miRNA and substitute sequences that target an mRNA to be silenced. Silencing by endogenous miRNAs can be found in a variety of spatial, temporal, and developmental expression patterns (Parizotto et al. (2007) Genes Dev 18:2237-2242; Alvarez et al. (2006) *Plant Cell* 18:1134-51). Artificial miRNA can be constructed to both capture and extend the diversity and specificity in the patterns of silencing. Previously, solutions for down-regulating specific fatty acid biosynthetic genes have been to use classic RNAi approaches, such as co-suppression or hairpin structures. These approaches included poor frequency of silencing (particularly with co-suppression strategies) and non-specific silencing of other similar genes. amiRNA technology can be designed to be very specific to the gene of interest and silencing frequencies are on par with RNAi (hairpin) structures.

WO 2004/009779 published Jan. 29, 2004 describes compositions and methods for modulating gene expression in plants.

Applicant's Assignee's US Patent Application Publication 2005/0138689 published on Jun. 23, 2005 describes miRNAs and their use in silencing a target sequence.

BRIEF DESCRIPTION OF THE SEQUENCE LISTING

The invention can be more fully understood from the following detailed description and the accompanying Sequence Listing, which form a part of this application.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219 (2):345-373 (1984).

SEQ ID NO:1 corresponds to the nucleotide sequence of soy fatty acid biosynthetic gene Glyma10g42470 targeted for silencing.

SEQ ID NO:2 corresponds to the amino acid sequence encoded by SEQ ID NO:1.

SEQ ID NO:3 corresponds to the nucleotide sequence of soy fatty acid biosynthetic gene Glyma20g24530 targeted for silencing.

SEQ ID NO:4 corresponds to the amino acid sequence encoded by SEQ ID NO:3.

SEQ ID NO:5 corresponds to the nucleotide sequence of soy fatty acid biosynthetic gene Glyma19g32940 targeted for silencing.

SEQ ID NO:6 corresponds to the amino acid sequence encoded by SEQ ID NO:5.

SEQ ID NO:7 corresponds to the nucleotide sequence of soy fatty acid biosynthetic gene Glyma02g15600 targeted for silencing.

SEQ ID NO:8 corresponds to the amino acid sequence encoded by SEQ ID NO:7.

SEQ ID NO:9 corresponds to the nucleotide sequence of soy fatty acid biosynthetic gene Glyma07g32850 targeted for silencing.

SEQ ID NO:10 corresponds to the amino acid sequence encoded by SEQ ID NO:9.

SEQ ID NO: 11 corresponds to the nucleotide sequence of soy fatty acid biosynthetic gene Glyma14g37350 targeted for silencing.

SEQ ID NO:12 corresponds to the amino acid sequence encoded by SEQ ID NO:11.

SEQ ID NO:13 corresponds to the nucleotide sequence of soy fatty acid biosynthetic gene Glyma02g39230 targeted for silencing.

SEQ ID NO:14 corresponds to the amino acid sequence encoded by SEQ ID NO:13.

SEQ ID NO:15 corresponds to the nucleotide sequence of soy fatty acid biosynthetic gene Glyma18g06950 targeted for silencing.

SEQ ID NO:16 corresponds to the amino acid sequence encoded by SEQ ID NO:15.

SEQ ID NO:17 corresponds to the nucleotide sequence of soy fatty acid biosynthetic gene Glyma05g08060 targeted for silencing.

SEQ ID NO:18 corresponds to the amino acid sequence encoded by SEQ ID NO:17.

SEQ ID NO:19 corresponds to the nucleotide sequence of soy fatty acid biosynthetic gene Glyma17g12940 targeted for silencing.

SEQ ID NO:20 corresponds to the amino acid sequence encoded by SEQ ID NO:19.

SEQ ID NOs:21-25 corresponds to the artificial miRNA (amiRNA) sequence used to silence the soybean fad 2-1b, fad2-2, sad3, fad3, and fatB, respectively.

SEQ ID NOs:26-31 correspond to "star sequences" contained within amiRNA precursors for 159fad2-1b, 396b-fad2-1b, 159-fad2-2, 396b-sad3, 159-fad3c, 159-fatbf, respectively. Star sequences are the largely complementary sequences within the miRNA precursor that form a duplex with the miRNA.

SEQ ID NO:32 corresponds to the nucleotide sequence of vector PH P32511.

SEQ ID NO:33 corresponds to the nucleotide sequence of vector PH P32510.

SEQ ID NO:34 corresponds to the nucleotide sequence of vector PHP32843.

SEQ ID NO:35 corresponds to the nucleotide sequence of vector PHP33705.

SEQ ID NO:36 corresponds to the nucleotide sequence of vector PHP38557.

SEQ ID NO:37 corresponds to the nucleotide sequence of vector PHP41103.

SEQ ID NO:38 corresponds to the nucleotide sequence of vector pKR1756.

SEQ ID NO:39 corresponds to the nucleotide sequence of vector pKR1757.

SEQ ID NO:40 corresponds to the nucleotide sequence of vector pKR1766.

SEQ ID NO:41 corresponds to the nucleotide sequence of vector pKR1771.

SEQ ID NO:42 corresponds to the nucleotide sequence of vector PHP41784.

SEQ ID NO:43 corresponds to the nucleotide sequence to the nucleotide sequence of vector pKR1776.

SEQ ID NO:44 corresponds to the nucleotide sequence of *Arabidopsis* fatty acid biosynthetic gene fad2, At3g12120.

SEQ ID NO:45 corresponds to the amino acid sequence encoded by SEQ ID NO:44.

SEQ ID NO:46 corresponds to the nucleotide sequence of *Arabidopsis* fatty acid biosynthetic gene fad3, At2g29980.

SEQ ID NO:47 corresponds to the amino acid sequence encoded by SEQ ID NO:46.

SEQ ID NO:48 corresponds to the nucleotide sequence of *Arabidopsis* fatty acid biosynthetic gene faeI, At4g34520.

SEQ ID NO:49 corresponds to the amino acid sequence encoded by SEQ ID NO:48.

SEQ ID NO:50 corresponds to the nucleotide sequence of *Brassica napus* fatty acid biosynthetic gene FJ907397.

SEQ ID NO:51 corresponds to the amino acid sequence encoded by SEQ ID NO:50.

SEQ ID NO:52 corresponds to the nucleotide sequence of *Brassica napus* fatty acid biosynthetic gene FJ907398.

SEQ ID NO:53 corresponds to the amino acid sequence encoded by SEQ ID NO:52.

SEQ ID NO:54 corresponds to the nucleotide sequence of *Brassica napus* fatty acid biosynthetic gene FJ907399.

SEQ ID NO:55 corresponds to the amino acid sequence encoded by SEQ ID NO:54.

SEQ ID NO:56 corresponds to the nucleotide sequence of *Brassica napus* fatty acid biosynthetic gene FJ907400.

SEQ ID NO:57 corresponds to the amino acid sequence encoded by SEQ ID NO:56.

SEQ ID NO:58 corresponds to the nucleotide sequence of *Brassica napus* fatty acid biosynthetic gene FJ907401.

SEQ ID NO:59 corresponds to the amino acid sequence encoded by SEQ ID NO:58.

SEQ ID NO:60 corresponds to the nucleotide sequence of *Brassica napus* fatty acid biosynthetic gene L01418.

SEQ ID NO:61 corresponds to the amino acid sequence encoded by SEQ ID NO:60.

SEQ ID NO:62 corresponds to the nucleotide sequence of *Brassica napus* fatty acid biosynthetic gene AY599884.

SEQ ID NO:63 corresponds to the amino acid sequence encoded by SEQ ID NO:62.

SEQ ID NO:64 corresponds to the nucleotide sequence of *Brassica napus* fatty acid biosynthetic gene L22962.

SEQ ID NO:65 corresponds to the amino acid sequence encoded by SEQ ID N0:64.

SEQ ID NO:66 corresponds to the nucleotide sequence of *Brassica napus* fatty acid biosynthetic gene AF274750.

SEQ ID NO:67 corresponds to the amino acid sequence encoded by SEQ ID NO:66.

SEQ ID NO:68 corresponds to the nucleotide sequence of *Brassica napus* fatty acid biosynthetic gene AY888043.

SEQ ID NO:69 corresponds to the amino acid sequence encoded by SEQ ID NO:68.

SEQ ID NO:70 corresponds to the nucleotide sequence of *Brassica napus* fatty acid biosynthetic gene AF009563.

SEQ ID NO:71 corresponds to the amino acid sequence encoded by SEQ ID NO:70.

SEQ ID NO:72 corresponds to the nucleotide sequence of *Brassica napus* fatty acid biosynthetic gene GU325719.

SEQ ID NO:73 corresponds to the amino acid sequence encoded by SEQ ID NO:72.

SEQ ID NO:74 corresponds to the nucleotide sequence of *Brassica napus* fatty acid biosynthetic gene AF490462.

SEQ ID NO:75 corresponds to the amino acid sequence encoded by SEQ ID NO:74.

SEQ ID NO:76 corresponds to the nucleotide sequence of *Brassica napus* fatty acid biosynthetic gene AF490459.

SEQ ID NO:77 corresponds to the amino acid sequence encoded by SEQ ID NO:76.

SEQ ID NO:78 corresponds to the nucleotide sequence of *Brassica napus* fatty acid biosynthetic gene BNU50771.

SEQ ID NO:79 corresponds to the amino acid sequence encoded by SEQ ID NO:78.

SEQ ID NO:80 corresponds to the fad2a amiRNA.

SEQ ID NO:81 corresponds to the fad2a 159 Star sequence.

SEQ ID NO:82 corresponds to the fad2a 396b Star sequence.

SEQ ID NO:83 corresponds to the fad2b 159 amiRNA.

SEQ ID NO:84 corresponds to the fad2b 159 Star sequence.

SEQ ID NO:85 corresponds to the fad2b 396b Star sequence.

SEQ ID NO:86 corresponds to the fad2c amiRNA.

SEQ ID NO:87 corresponds to the fad2c 159 Star sequence.

SEQ ID NO:88 corresponds to the fad2c 396b Star sequence.

SEQ ID NO:89 corresponds to the fad3a amiRNA.

SEQ ID NO:90 corresponds to the fad3a 159 Star sequence.
SEQ ID NO:91 corresponds to the fad3a 396b Star sequence.
SEQ ID NO:92 corresponds to the fad3b amiRNA.
SEQ ID NO:93 corresponds to the fad3b 159 Star sequence.
SEQ ID NO:94 corresponds to the fad3b 396b Star sequence.
SEQ ID NO:95 corresponds to the faeIa amiRNA.
SEQ ID NO:96 corresponds to the faeIa 159 Star sequence.
SEQ ID NO:97 corresponds to the faeIa 396b Star sequence.
SEQ ID NO:98 corresponds tot the faeIb amiRNA.
SEQ ID NO:99 corresponds to the faeIb 159 Star sequence.
SEQ ID NO:100 corresponds to the faeIb 396b Star sequence.
SEQ ID NO:101 corresponds to the faeIc amiRNA.
SEQ ID NO:102 corresponds to the faeIc 159 Star sequence.
SEQ ID NO:103 corresponds to the faeIc 396b Star sequence.
SEQ ID NO:104 corresponds to the nucleotide sequence of plasmid GM-159-KS332.
SEQ ID NO:105 corresponds to the nucleotide sequence of plasmid GM-396b-KS332.
SEQ ID NO:106 corresponds to the nucleotide sequence of plasmid pKR2007.
SEQ ID NO:107 corresponds to the nucleotide sequence of plasmid pKR2009.
SEQ ID NO:108 corresponds to the nucleotide sequence of plasmid pKR2032.
SEQ ID NO:109 corresponds to the nucleotide sequence of plasmid pKR2033.
SEQ ID NO:110 corresponds to the nucleotide sequence of plasmid pKR2034.
SEQ ID NO:111 corresponds to the nucleotide sequence of plasmid pKR2037
SEQ ID NO:112 corresponds to the nucleotide sequence of plasmid pKR2038.
SEQ ID NO:113 corresponds to the nucleotide sequence of plasmid pKR2039.
SEQ ID NO:114 corresponds to the nucleotide sequence of plasmid pKR2035.
SEQ ID NO:115 corresponds to the nucleotide sequence of plasmid pKR2036.
SEQ ID NO:116 corresponds to the nucleotide sequence of plasmid pKR2040.
SEQ ID NO:117 corresponds to the nucleotide sequence of plasmid pKR2041.
SEQ ID NO:118 corresponds to the nucleotide sequence of plasmid pKR2076.
SEQ ID NO:119 corresponds to the nucleotide sequence of plasmid pKR2077.
SEQ ID NO:120 corresponds to the nucleotide sequence of plasmid pKR2078.
SEQ ID NO:121 corresponds to the nucleotide sequence of plasmid pKR2079.
SEQ ID NO:122 corresponds to the nucleotide sequence of plasmid pKR2081.
SEQ ID NO:123 corresponds to the nucleotide sequence of plasmid pKR2080.
SEQ ID NO:124 corresponds to the nucleotide sequence of amiRNA precursor 159-fad2-1b.
SEQ ID NO:125—corresponds to the nucleotide sequence of amiRNA precursor 396b-fad2-1b.
SEQ ID NO:126—corresponds to the nucleotide sequence of amiRNA precursor 159-fad2-2.
SEQ ID NO:127—corresponds to the nucleotide sequence of amiRNA precursor 396b-fad2-1b & 159-fad2-2.
SEQ ID NO:128—corresponds to the nucleotide sequence of amiRNA precursor 396b-sad3.
SEQ ID NO:129—corresponds to the nucleotide sequence of amiRNA precursor 396b-fad2-1b/396b-sad3.
SEQ ID NO:130—corresponds to the nucleotide sequence of amiRNA precursor 159-fad3c.
SEQ ID NO:131—corresponds to the nucleotide sequence of amiRNA precursor 159-fatBF.
SEQ ID NO:132—corresponds to the nucleotide sequence of amiRNA precursor 159-fad3c/159-fatBF.
SEQ ID NO:133—corresponds to the nucleotide sequence of amiRNA precursor 159-fatBF/159-fad3c.
SEQ ID NO:134—corresponds to the nucleotide sequence of amiRNA precursor 159-fad2-1b/159-fatBF/159-fad3c.
SEQ ID NO:135—corresponds to the nucleotide sequence of amiRNA precursor 396b-fad2-1b/159-fatB/159-fad3c.
SEQ ID NO:136—corresponds to the nucleotide sequence of amiRNA precursor 159-Atfad2a.
SEQ ID NO:137—corresponds to the nucleotide sequence of amiRNA precursor 159-Atfad2b.
SEQ ID NO:138 corresponds to the nucleotide sequence of corresponds to the nucleotide sequence of amiRNA precursor 159-Atfad2c.
SEQ ID NO:139—corresponds to the nucleotide sequence of amiRNA precursor 396b-Atfad2a.
SEQ ID NO:140—corresponds to the nucleotide sequence of amiRNA precursor 396b-Atfad2b.
SEQ ID NO:141—corresponds to the nucleotide sequence of amiRNA precursor 396b-Atfad2c.
SEQ ID NO:142—corresponds to the nucleotide sequence of amiRNA precursor 159-Atfad3a.
SEQ ID NO:143—corresponds to the nucleotide sequence of amiRNA precursor 159-Atfad3b
SEQ ID NO:144—corresponds to the nucleotide sequence of amiRNA precursor 396b-Atfad3a.
SEQ ID NO:145—corresponds to the nucleotide sequence of amiRNA precursor 396b-Atfad3b.
SEQ ID NO:146—corresponds to the nucleotide sequence of amiRNA precursor 159-AtfaeIa.
SEQ ID NO:147—corresponds to the nucleotide sequence of amiRNA precursor 59-AtfaeIb.
SEQ ID NO:148—corresponds to the nucleotide sequence of amiRNA precursor 159-AtfaeIc.
SEQ ID NO:149—corresponds to the nucleotide sequence of amiRNA precursor 396b-AtfaeIa.
SEQ ID NO:150—corresponds to the nucleotide sequence of amiRNA precursor 396b-AtfaeIb.
SEQ ID NO:151—corresponds to the nucleotide sequence of amiRNA precursor 396b-AtfaeIc.
SEQ ID NO:152—corresponds to the nucleotide sequence of soy genomic miRNA precursor 159.
SEQ ID NO:153—corresponds to the nucleotide sequence of soy genomic miRNA precursor 396b.
SEQ ID NO:154—corresponds to the nucleotide sequence of the 159-fad2a/396b-fad3b amiRNA.
SEQ ID NO:155—corresponds to the nucleotide sequence of plasmid pKR2232.
SEQ ID NO:156—corresponds to the nucleotide sequence of the 159-fad2b/396b-fad3b amiRNA.

SEQ ID NO:157—corresponds to the nucleotide sequence of plasmid pKR2233

SEQ ID NO:158—corresponds to the nucleotide sequence of the 396b-fad3b/159-fad2a amiRNA.

SEQ ID NO:159—corresponds to the nucleotide sequence of plasmid pKR2234.

SEQ ID NO:160—corresponds to the nucleotide sequence of the 396b-fad3b/159-fad2b amiRNA SEQ ID NO:161—corresponds to the nucleotide sequence of plasmid pKR2235.

SEQ ID NO:162—corresponds to the nucleotide sequence of the 159-fad2a/396b-fad3b/159-faeIa amiRNA.

SEQ ID NO:163—corresponds to the nucleotide sequence of plasmid pKR2248.

SEQ ID NO:164—corresponds to the nucleotide sequence of the 396b-fad3b/159-fad2a/159-faeIa amiRNA.

SEQ ID NO:165—correpsonds to the nucleotide sequence of plasmid 396b-fad3b/159-fad2a/159-faeIa amiRNA.

SEQ ID NO:166—corresponds to the nucleotide sequence of the 159-fad2b/396b-fad3b/159-faeIa amiRNA.

SEQ ID NO:167—corresponds to the nucleotide sequence of plasmid pKR2250.

SEQ ID NO:168—corresponds to the nucleotide sequence of 396b-fad3b/159-fad2b/159-faeIa amiRNA.

SEQ ID NO:169—corresponds to plasmid pKR2251.

SEQ ID NO:170—corresponds to plasmid pKR2333.

SEQ ID NO:171—corresponds to plasmid pKR2334.

SEQ ID NO:172—corresponds to plasmid pKR2335.

SEQ ID NO:173—corresponds to plasmid pKR2336.

SEQ ID NO:174—corresponds to the fad 2 nucleotide sequence of Brassica carinata.

SEQ ID NO:175—corresponds to the amino acid sequence encoded by SEQ ID NO:174.

SUMMARY OF THE INVENTION

The present invention concerns an isolated nucleic acid fragment comprising a sequence encoding an artificial microRNA precursor, operably linked to at least one regulatory sequence, wherein said sequence encoding an artificial microRNA precursor is transcribed so that a transcript comprising said artificial miRNA precursor is produced, and wherein said transcript is processed so that a mature miRNA about 21 to 22 nts in length is excised from said artificial miRNA precursor, and expression of a plant fatty acid biosynthetic gene selected from the group consisting of: fad2-1, fad2-2, fad3, fatB, sad, and faeI is inhibited. The plant fatty acid biosynthetic genes include without limitation any of the nucleotide sequences of SEQ ID NOs:1, 3, 5, 7, 9, 11, 13, 15, 17, 19, 44, 46, 48, 50, 52, 54, 56, 58, 60, 62, 64, 66, 68, 70, 72, 74, 76, 78, and 174, which encode amino acid sequences of SEQ ID NOs: 2, 4, 6, 8, 10, 12, 14, 16, 18, 20, 45, 47, 49, 51, 53, 55, 57, 59, 61, 63, 65, 67, 69, 71, 73, 75, 77, 79, and 175.

Another embodiment of the present invention concerns an isolated nucleic acid fragment comprising a sequence encoding an artificial microRNA precursor, wherein said artificial microRNA precursor is at least one selected form the group consisting of SEQ ID NO: 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 156, 158, 160, 162, 164, 166, and 168.

An additional embodiment of the present invention concerns recombinant constructs comprising the isolated nucleic acid sequence of the invention operably linked to at least one regulatory sequence.

Additional embodiments of the present inventions comprise an isolated nucleic acid sequence comprising a sequence encoding two or more artificial microRNA precursors, operably linked to at least one regulatory sequence, wherein said two or more artificial microRNA precursor can be on the same or separate transcriptional units, further wherein said sequence encoding artificial microRNA precursors is transcribed so that a transcript comprising said artificial miRNA precursors is produced, and wherein said transcript is processed so that mature miRNAs about 21 to 22 nts in length are excised from said artificial miRNA precursors, and expression of two or more plant fatty acid biosynthetic gene(s) selected from the group consisting of: fad2-1, fad2-2, fad3, fatB, sad, and faeI is inhibited.

Another embodiment of the instant invention includes a method for reducing expression two or more plant fatty acid biosynthetic gene, said method comprising:

(a) transforming a plant cell with at least one isolated nucleic acid sequence comprising a sequence encoding two or more artificial microRNA precursors, wherein said two or more artificial microRNA precursors can be on the same or separate transcriptional units, operably linked to at least one regulatory sequence;

(b) said at least one sequence encoding two or more artificial microRNA precursors is transcribed so that at least one transcript comprising said two or more artificial miRNA precursors is produced;

(c) said at least one transcript is processed so that at least two or more mature miRNAs about 21 to 22 nts in length are excised from said artificial miRNA precursors, and (d) expression of two or more plant fatty acid biosynthetic genes selected from the group consisting of: fad2-1, fad2-2, fad3, fatB, sad, and faeI are reduced. Recombinant constructs and plant cells comprising the recombinant construct of the invention are also included. Dicot plant cells comprising the recombinant constructs of the invention are further embodiment. In another aspect, this invention concerns a method for reducing expression of at least one plant fatty acid biosynthetic gene in a plant cell, said method comprising:

(a) transforming a plant cell with at least one isolated nucleic acid sequence comprising a sequence encoding an artificial microRNA precursor, operably linked to at least one regulatory sequence;

(b) said at least one sequence encoding an artificial microRNA precursor is transcribed so that a transcript comprising said at least one artificial miRNA precursor is produced;

(c) said transcript is processed so that at least one mature miRNA about 21 to 22 nts in length is excised from said artificial miRNA precursor, and (d) expression of at least one plant fatty acid biosynthetic gene selected from the group consisting of: fad2-1, fad2-2, fad3, fatB, sad, and faeI is reduced.

A further embodiment of the invention includes an isolated nucleic acid sequence comprising a sequence encoding at least one artificial microRNA precursor, operably linked to at least one regulatory sequence, wherein said sequence encoding at least one artificial microRNA precursor is capable of forming a double-stranded RNA or hairpin, wherein the at least one amiRNA precursor comprises at least one modified miRNA precursor in which the miRNA sequence and its complementary sequence are replaced by at least one amiRNA sequence and at least one STAR sequence, wherein expression of at least one plant fatty acid biosynthetic gene(s) selected from the group consisting of: fad2-1, fad2-2, fad3, fatB, sad, and faeI is inhibited.

A further embodiment of the invention comprises an isolated nucleic acid sequence comprising a sequence encoding two or more artificial microRNA precursors, operably linked to at least one regulatory sequence, wherein said two or more artificial microRNA precursor can be on the same or separate transcriptional units, further wherein said sequences encoding two or more artificial microRNA precursors are capable of forming a double-stranded RNA or hairpin, wherein the two or more amiRNA precursors comprise a modified miRNA precursor(s) in which the miRNA sequence(s) and its complementary sequence(s) are replaced by two or more amiRNA sequences and two or more STAR sequences, and further wherein expression of at least two or more plant fatty acid biosynthetic genes selected from the group consisting of: fad2-1, fad2-2, fad3, fatB, sad, and faeI, are inhibited.

In yet another embodiment the instant invention included any of the isolated nucleic acid sequences of the instant invention, wherein the amiRNA sequence(s) comprise(s) at least one selected form the group consisting of: SEQ ID NO: 21, 22, 23, 24, 25, 80, 83, 86, 89, 92, 95, 98, and 101.

Transgenic plants or seed comprising these amiRNAs are also part of the invention and methods according to the invention that use these amiRNAs are also comprised by the instant invention.

DETAILED DESCRIPTION

Information pertinent to this application can be found in U.S. patent application Ser. Nos. 10/963,238 and 10/963,394, filed Oct. 12, 2004. The entire contents of the above applications are herein incorporated by reference.

Applicant's Assignee's US Patent Application Publication 2009/0155910 A1 published on Jun. 18, 2009 describes the down-regulation of gene expression using artificial miRNAs. The entire contents of the above applications are herein incorporated by reference.

Other references that may be useful in understanding the invention include U.S. patent application Ser. No. 10/883,374, filed Jul. 1, 2004; U.S. patent application Ser. No. 10/913,288, filed Aug. 6, 2004; and U.S. patent application Ser. No. 11/334,776, filed Jan. 6, 2006.

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

"microRNA or miRNA" refers to oligoribonucleic acid, which regulates expression of a polynucleotide comprising the target sequence. microRNAs (miRNAs) are noncoding RNAs of about 19 to about 24 nucleotides (nt) in length that have been identified in both animals and plants (Lagos-Quintana et al., Science 294:853-858 2001, Lagos-Quintana et al., Curr. Biol. 12:735-739 2002; Lau et al., Science 294:858-862 2001; Lee and Ambros, Science 294:862-864 2001; Llave et al., Plant Cell 14:1605-1619 2002; Mourelatos et al., Genes. Dev. 16:720-728 2002; Park et al., Curr. Biol. 12:1484-1495 2002; Reinhart et al., Genes. Dev. 16:1616-1626 2002) which regulates expression of a polynucleotide comprising the target sequence. They are processed from longer precursor transcripts that range in size from approximately 70 to 2000 nt or longer, and these precursor transcripts have the ability to form stable hairpin structures. In animals, the enzyme involved in processing miRNA precursors is called Dicer, an RNAse III-like protein (Grishok et al., Cell 106:23-34 2001; Hutvagner et al., Science 293:834-838 2001; Ketting et al., Genes. Dev. 15:2654-2659 2001). Plants also have a Dicer-like enzyme, DCL1 (previously named CARPEL FACTORY/SHORT INTEGUMENTS1/SUSPENSOR1), and recent evidence indicates that it, like Dicer, is involved in processing the hairpin precursors to generate mature miRNAs (Park et al., Curr. Biol. 12:1484-1495 2002; Reinhart et al., Genes. Dev. 16:1616-1626 2002). Furthermore, it is becoming clear from recent work that at least some miRNA hairpin precursors originate as longer polyadenylated transcripts, and several different miRNAs and associated hairpins can be present in a single transcript (Lagos-Quintana et al., Science 294:853-858 2001; Lee et al., EMBO J. 21:4663-4670 2002). Recent work has also examined the selection of the miRNA strand from the dsRNA product arising from processing of the hairpin by DICER (Schwartz et al., 2003, Cell 115:199-208). It appears that the stability (i.e. G:C vs. A:U content, and/or mismatches) of the two ends of the processed dsRNA affects the strand selection, with the low stability end being easier to unwind by a helicase activity. The 5' end strand at the low stability end is incorporated into the RISC complex, while the other strand is degraded.

"pri-miRNAs" or "primary miRNAs" are long, polyadenylated RNAs transcribed by RNA polymerase II that encode miRNAs. "pre-miRNAs" are primary miRNAs that have been processed to form a shorter sequence that has the capacity to form a stable hairpin and is further processed to release a miRNA. In plants both processing steps are carried out by dicerlike and it is therefore difficult to functionally differentiate between "pri-miRNAs" and "pre-miRNAs". Therefore, a precursor miRNA, or a primary miRNA, is functionally defined herein as a nucleotide sequence that is capable of producing a miRNA. Given this functional definition, and as will be clear from the Examples and discussion herein, a precursor miRNA, primary miRNA and/or a miRNA of the invention can be represented as a ribonucleic acid or, alternatively, in a deoxyribonucleic acid form that "corresponds substantially" to the precursor miRNA, primary miRNA and/or miRNA. It is understood that the DNA in its double-stranded form will comprise a strand capable of being transcribed into the miRNA precursor described. Expression constructs, recombinant DNA constructs, and transgenic organisms incorporating the miRNA encoding DNA that results in the expression of the described miRNA precursors are described.

A "variable nucleotide subsequence" refers to a portion of a nucleotide sequence that replaces a portion of a pre-miRNA sequence provided that this subsequence is different from the sequence that is being replaced, i.e, it cannot be the same sequence.

A "target gene" refers to a gene that encodes a target RNA, ie., a gene from which a target RNA is transcribed. The gene may encode mRNA, tRNA, small RNA, etc.

A "target sequence" refers to an RNA whose expression is to be modulated, e.g., down-regulated. The target sequence may be a portion of an open reading frame, 5' or 3' untranslated region, exon(s), intron(s), flanking region, etc.

A "star sequence" is the complementary sequence within a miRNA precursor that forms a duplex with the miRNA. The complementarity of the star sequence does not need to be perfect. Non-helix disrupting substitutions (i.e. G:T base pairs etc.) are sometimes found, as well as 1-3 mismatches.

The term "genome" refers to the following: (1) the entire complement of genetic material (genes and non-coding sequences) present in each cell of an organism, or virus or organelle; (2) a complete set of chromosomes inherited as a (haploid) unit from one parent.

"Progeny" comprises any subsequent generation of a plant. Progeny will inherit, and stably segregate, genes and transgenes from its parent plant(s).

Units, prefixes, and symbols may be denoted in their SI accepted form. Unless otherwise indicated, nucleic acids are written left to right in 5' to 3' orientation; amino acid sequences are written left to right in amino to carboxyl orientation, respectively. Numeric ranges recited within the specification are inclusive of the numbers defining the range and include each integer within the defined range. Amino acids may be referred to herein by either commonly known three letter symbols or by the one-letter symbols recommended by the IUPAC-IUB Biochemical Nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms ($5^{th}$ edition, 1993). The terms defined below are more fully defined by reference to the specification as a whole.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., EMBO J. 4:2411-2418 (1985); De Almeida et al., Mol. Gen. Genetics 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

This construct may comprise any combination of deoxyribonucleotides, ribonucleotides, and/or modified nucleotides. The construct may be transcribed to form an RNA, wherein the RNA may be capable of forming a double-stranded RNA and/or hairpin structure. This construct may be expressed in the cell, or isolated or synthetically produced. The construct may further comprise a promoter, or other sequences which facilitate manipulation or expression of the construct.

As used here "suppression" or "silencing" or "inhibition" are used interchangeably to denote the down-regulation of the expression of a product of a target sequence relative to its normal expression level in a wild type organism. Suppression includes expression that is decreased by about 10%, 15%, 20%, 25%, 30%, 35%, 40%, 45%, 50%, 55%, 60%, 65%, 70%, 75%, 80%, 85%, 90%, 95%, or 100% relative to the wild type expression level.

As used herein, "encodes" or "encoding" refers to a DNA sequence which can be processed to generate an RNA and/or polypeptide.

As used herein, "expression" or "expressing" refers to production of a functional product, such as, the generation of an RNA transcript from an introduced construct, an endogenous DNA sequence, or a stably incorporated heterologous DNA sequence. The term may also refer to a polypeptide produced from an mRNA generated from any of the above DNA precursors. Thus, expression of a nucleic acid fragment may refer to transcription of the nucleic acid fragment (e.g., transcription resulting in mRNA or other functional RNA) and/or translation of RNA into a precursor or mature protein (polypeptide).

As used herein, "heterologous" with respect to a sequence means a sequence that originates from a foreign species, or, if from the same species, is substantially modified from its native form in composition and/or genomic locus by deliberate human intervention. For example, with respect to a nucleic acid, it can be a nucleic acid that originates from a foreign species, or is synthetically designed, or, if from the same species, is substantially modified from its native form in composition and/or genomic locus by deliberate human intervention. A heterologous protein may originate from a foreign species or, if from the same species, is substantially modified from its original form by deliberate human intervention.

The term "host cell" refers to a cell which contains or into which is introduced a nucleic acid construct and supports the replication and/or expression of the construct. Host cells may be prokaryotic cells such as E. coli, or eukaryotic cells such as fungi, yeast, insect, amphibian, nematode, or mammalian cells. Alternatively, the host cells are monocotyledonous or dicotyledonous plant cells. An example of a monocotyledonous host cell is a maize host cell.

"Plant" includes reference to whole plants, plant organs, plant tissues, seeds and plant cells and progeny of same. Plant cells include, without limitation, cells from seeds, suspension cultures, embryos, meristematic regions, callus tissue, leaves, roots, shoots, gametophytes, sporophytes, pollen, and microspores.

The term "plant parts" includes differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or group of tissues that constitute a morphologically and functionally distinct part of a plant.

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into ac ell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

The term "genome" as it applies to a plant cells encompasses not only chromosomal DNA found within the nucleus, but organelle DNA found within subcellular components (e.g., mitochondrial, plastid) of the cell.

The term "isolated" refers to material, such as a nucleic acid or a protein, which is: (1) substantially or essentially free from components which normally accompany or interact with the material as found in its naturally occurring environment or (2) if the material is in its natural environment, the material has been altered by deliberate human intervention to a composition and/or placed at a locus in the cell other than the locus native to the material.

As used herein, "domain" or "functional domain" refer to nucleic acid sequence(s) that are capable of eliciting a biological response in plants. The present invention concerns miRNAs composed of at least 21 nucleotide sequences acting either individually, or in concert with other miRNA sequences, therefore a domain could refer to either individual miRNAs or groups of miRNAs. Also, miRNA sequences associated with their backbone sequences could be considered domains useful for processing the miRNA into its active form. As used herein, "subdomains" or "functional subdomains" refer to subsequences of domains that are capable of eliciting a biological response in plants. A miRNA could be considered a subdomain of a backbone sequence. "Contiguous" sequences or domains refer to sequences that are sequentially linked without added nucleotides intervening between the domains. An example of a contiguous domain string is found in SEQ ID NO:7957 which represents SEQ ID NOs: 1-2652 as a continuous string that can be thought of as 2652 miRNA sequences linked together in a sequential concatenation.

RNA interference refers to the process of sequence-specific post-transcriptional gene silencing in animals mediated by short interfering RNAs (siRNAs) (Fire et al., Nature 391:806 1998). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., Trends Genet. 15:358 1999). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as "dicer".

Dicer is involved in the processing of the dsRNA into short pieces of dsRNA known as short interfering RNAs (siRNAs) (Berstein et al., Nature 409:363 2001) and/or pre miRNAs into miRNAs. Short interfering RNAs derived from dicer activity are typically about 21 to about 23 nucleotides in length and comprise about 19 base pair duplexes (Elbashir et al., Genes Dev. 15:188 2001). Dicer has also been implicated in the excision of 21- and 22-nucleotide small temporal RNAs (stRNAs) from precursor RNA of conserved structure that are implicated in translational control (Hutvagner et al., 2001, Science 293:834). The RNAi response also features an endonuclease complex, commonly referred to as an RNA-induced silencing complex (RISC), which mediates cleavage of single-stranded RNA having sequence complementarity to the antisense strand of the sRNA duplex. Cleavage of the target RNA takes place in the middle of the region complementary to the antisense strand of the sRNA duplex (Elbashir et al., Genes Dev. 15:188 2001). In addition, RNA interference can also involve small RNA (e.g., microRNA, or miRNA) mediated gene silencing, presumably through cellular mechanisms that regulate chromatin structure and thereby prevent transcription of target gene sequences (see, e.g., Allshire, Science 297:1818-1819 2002; Volpe et al., Science 297:1833-1837 2002; Jenuwein, Science 297:2215-2218 2002; and Hall et al., Science 297: 2232-2237 2002). As such, miRNA molecules of the invention can be used to mediate gene silencing via interaction with RNA transcripts or alternately by interaction with particular gene sequences, wherein such interaction results in gene silencing either at the transcriptional or post-transcriptional level.

RNAi has been studied in a variety of systems. Fire et al. (Nature 391:806 1998) were the first to observe RNAi in C. elegans. Wianny and Goetz (Nature Cell Biol. 2:70 1999) describe RNAi mediated by dsRNA in mouse embryos. Hammond et al. (Nature 404:293 2000) describe RNAi in Drosophila cells transfected with dsRNA. Elbashir et al., (Nature 411:494 2001) describe RNAi induced by introduction of duplexes of synthetic 21-nucleotide RNAs in cultured mammalian cells including human embryonic kidney and HeLa cells.

Small RNAs play an important role in controlling gene expression. Regulation of many developmental processes, including flowering, is controlled by small RNAs. It is now possible to engineer changes in gene expression of plant genes by using transgenic constructs which produce small RNAs in the plant.

Small RNAs appear to function by base-pairing to complementary RNA or DNA target sequences. When bound to RNA, small RNAs trigger either RNA cleavage or translational inhibition of the target sequence. When bound to DNA target sequences, it is thought that small RNAs can mediate DNA methylation of the target sequence. The consequence of these events, regardless of the specific mechanism, is that gene expression is inhibited.

MicroRNAs (miRNAs) are noncoding RNAs of about 19 to about 24 nucleotides (nt) in length that have been identified in both animals and plants (Lagos-Quintana et al., Science 294:853-858 2001, Lagos-Quintana et al., Curr. Biol. 12:735-739 2002; Lau et al., Science 294:858-862 2001; Lee and Ambros, Science 294:862-864 2001; Llave et al., Plant Cell 14:1605-1619 2002; Mourelatos et al., Genes. Dev. 16:720-728 2002; Park et al., Curr. Biol. 12:1484-1495 2002; Reinhart et al., Genes. Dev. 16:1616-1626 2002). They are processed from longer precursor transcripts that range in size from approximately 70 to 200 nt, and these precursor transcripts have the ability to form stable hairpin structures. In animals, the enzyme involved in processing miRNA precursors is called Dicer, an RNAse III-like protein (Grishok et al., *Cell* 106:23-34 2001; Hutvagner et al., *Science* 293:834-838 2001; Ketting et al., *Genes. Dev.* 15:2654-2659 2001). Plants also have a Dicer-like enzyme, DCL1 (previously named CARPEL FACTORY/SHORT INTEGUMENTS1/SUSPENSOR1), and recent evidence indicates that it, like Dicer, is involved in processing the hairpin precursors to generate mature miRNAs (Park et al., *Curr. Biol.* 12:1484-1495 2002; Reinhart et al., *Genes. Dev.* 16:1616-1626 2002). Furthermore, it is becoming clear from recent work that at least some miRNA hairpin precursors originate as longer polyadenylated transcripts, and several different miRNAs and associated hairpins can be present in a single transcript (Lagos-Quintana et al., *Science* 294:853-858 2001; Lee et al., *EMBO J.* 21:4663-4670 2002). Recent work has also examined the selection of the miRNA strand from the dsRNA product arising from processing of the hairpin by DICER (Schwartz et al., 2003, Cell 115:199-208). It appears that the stability (i.e. G:C vs. A:U content, and/or mismatches) of the two ends of the processed dsRNA affects the strand selection, with the low stability end being easier to unwind by a helicase activity. The 5' end strand at the low stability end is incorporated into the RISC complex, while the other strand is degraded.

In animals, there is direct evidence indicating a role for specific miRNAs in development. The lin-4 and let-7 miRNAs in *C. elegans* have been found to control temporal development, based on the phenotypes generated when the genes producing the lin-4 and let-7 miRNAs are mutated (Lee et al., *Cell* 75:843-854 1993; Reinhart et al., *Nature* 403-901-906 2000). In addition, both miRNAs display a temporal expression pattern consistent with their roles in developmental timing. Other animal miRNAs display developmentally regulated patterns of expression, both temporal and tissue-specific (Lagos-Quintana et al., *Science* 294:853-853 2001, Lagos-Quintana et al., *Curr. Biol.* 12:735-739 2002; Lau et al., *Science* 294:858-862 2001; Lee and Ambros, *Science* 294:862-864 2001), leading to the hypothesis that miRNAs may, in many cases, be involved in the regulation of important developmental processes. Likewise, in plants, the differential expression patterns of many miRNAs suggests a role in development (Llave et al., *Plant Cell* 14:1605-1619 2002; Park et al., *Curr. Biol.* 12:1484-1495 2002; Reinhart et al., *Genes. Dev.* 16:1616-1626 2002). However, a developmental role for miRNAs has not been directly proven in plants, because to date there has been no report of a developmental phenotype associated with a specific plant miRNA.

MicroRNAs appear to regulate target genes by binding to complementary sequences located in the transcripts produced by these genes. In the case of lin-4 and let-7, the target sites are located in the 3' UTRs of the target mRNAs (Lee et al., *Cell* 75:843-854 1993; Wightman et al., *Cell* 75:855-862 1993; Reinhart et al., *Nature* 403:901-906 2000; Slack et al., *Mol. Cell.* 5:659-669 2000), and there are several mismatches between the lin-4 and let-7 miRNAs and their target sites. Binding of the lin-4 or let-7 miRNA appears to cause downregulation of steady-state levels of the protein encoded by the target mRNA without affecting the transcript itself (Olsen and Ambros, *Dev. Biol.* 216:671-680 1999). On the other hand, recent evidence suggests that miRNAs can, in some cases, cause specific RNA cleavage of the target transcript within the target site (Hutvagner and Zamore, *Science* 297:2056-2060 2002; Llave et al., *Plant Cell* 14:1605-1619 2002). It seems likely that miRNAs can enter at least two pathways of target gene regulation: Protein downregulation and RNA cleavage. MicroRNAs entering the RNA cleavage pathway incorporated into an RNA-induced silencing complex (RISC) that is similar or identical to that seen for RNAi.

The present invention concerns an isolated nucleic acid fragment comprising a sequence encoding an artificial microRNA precursor, operably linked to at least one regulatory sequence, wherein said sequence encoding an artificial microRNA precursor is transcribed so that a transcript comprising said artificial miRNA precursor is produced, and wherein said transcript is processed so that a mature miRNA about 21 to 22 nts in length is excised from said artificial miRNA precursor, and expression of a plant fatty acid biosynthetic gene selected from the group consisting of: fad2-1, fad2-2, fad3, fatB, sad, and faeI is inhibited.

Another embodiment of the present invention concerns an isolated nucleic acid fragment comprising a sequence encoding an artificial microRNA precursor, wherein said artificial microRNA precursor is at least one selected form the group consisting of SEQ ID NO: 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 156, 158, 160, 162, 164, 166, and 168.

Yet another embodiment of the present invention comprises an isolated nucleic acid sequence comprising a sequence encoding two or more artificial microRNA precursors, operably linked to at least one regulatory sequence, wherein said two or more artificial microRNA precursor can be on the same or separate transcriptional units, further wherein said sequence encoding artificial microRNA precursors is transcribed so that a transcript comprising said artificial miRNA precursors is produced, and wherein said transcript is processed so that mature miRNAs about 21 to 22 nts in length are excised from said artificial miRNA precursors, and expression of two or more plant fatty acid biosynthetic gene(s) selected from the group consisting of: fad2-1, fad2-2, fad3, fatB, sad, and faeI is inhibited. The plant fatty acid biosynthetic genes include without limitation any of the nucleotide sequences of SEQ ID NOs:1, 3, 5, 7, 9, 11, 13, 15, 17, 19, 44, 46, 48, 50, 52, 54, 56, 58, 60, 62, 64, 66, 68, 70, 72, 74, 76, 78, and 174, which encode amino acid sequences of SEQ ID NOs: 2, 4, 6, 8, 10, 12, 14, 16, 18, 20, 45, 47, 49, 51, 53, 55, 57, 59, 61, 63, 65, 67, 69, 71, 73, 75, 77, 79, and 175.

Another embodiment comprises a method for reducing expression two or more plant fatty acid biosynthetic gene, said method comprising:
  (a) transforming a plant cell with at least one isolated nucleic acid sequence comprising a sequence encoding two or more artificial microRNA precursors, wherein said two or more artificial microRNA precursors can be on the same or separate transcriptional units, operably linked to at least one regulatory sequence;
  (b) said at least one sequence encoding two or more artificial microRNA precursors is transcribed so that at least one transcript comprising said two or more artificial miRNA precursors is produced;
  (c) said at least one transcript is processed so that at least two or more mature miRNAs about 21 to 22 nts in length are excised from said artificial miRNA precursors, and
  (d) expression of two or more plant fatty acid biosynthetic genes selected from the group consisting of: fad2-1, fad2-2, fad3, fatB, sad, and faeI are reduced.

An additional embodiment of the present invention concerns recombinant constructs comprising the isolated nucleic acid sequence of the invention operably linked to at least one regulatory sequence.

Plant cells comprising the recombinant construct of the invention are also included. Dicot plant cells comprising the recombinant constructs of the invention are further embodiment. In another aspect, this invention concerns a method for reducing expression of at least one plant fatty acid biosynthetic gene in a plant cell, said method comprising:
  (a) transforming a plant cell with at least one isolated nucleic acid sequence comprising a sequence encoding an artificial microRNA precursor, operably linked to at least one regulatory sequence;
  (b) said at least one sequence encoding an artificial microRNA precursor is transcribed so that a transcript comprising said at least one artificial miRNA precursor is produced;
  (c) said transcript is processed so that at least one mature miRNA about 21 to 22 nts in length is excised from said artificial miRNA precursor, and
  (d) expression of at least one plant fatty acid biosynthetic gene selected from the group consisting of: fad2-1, fad2-2, fad3, fatB, sad, and faeI is reduced.

Any of these isolated nucleic acid fragments can be used to make a recombinant construct comprising these isolated nucleic acid fragments operably linked to at least one regulatory sequence. These constructs can be transformed into plant cells so that the transformed plant cell comprises the recombinant construct in its genome. Preferably, the plant cell can be a dicot plant cell. Examples of dicot plant cells include, but are not limited to, soybean, rapeseed (e.g. *Brassica napus*), sunflower, flax, cotton, alfalfa, barley, bean, pea, tobacco, and *Arabidopsis*.

The most preferred dicot plant cell is soybean.

The present invention concerns an isolated nucleic acid fragment comprising a sequence encoding an artificial microRNA precursor, operably linked to at lea.

st one regulatory sequence, wherein said sequence encoding an artificial microRNA precursor is transcribed so that a transcript comprising said artificial miRNA precursor is produced, and wherein said transcript is processed so that a mature miRNA about 21 to 22 nts in length is excised from said artificial miRNA precursor, and expression of a plant fatty acid biosynthetic gene selected from the group consisting of: fad2-1, fad2-2, fad3, fatB, sad, and faeI is inhibited.

Another embodiment of the present invention concerns an isolated nucleic acid fragment comprising a sequence encoding an artificial microRNA precursor, wherein said artificial microRNA precursor is at least one selected form the group consisting of SEQ ID NO: 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 156, 158, 160, 162, 164, 166, and 168.

An additional embodiment of the present invention concerns recombinant constructs comprising the isolated nucleic acid sequence of the invention operably linked to at least one regulatory sequence.

Additional embodiments of the present inventions comprise an isolated nucleic acid sequence comprising a sequence encoding two or more artificial microRNA precursors, operably linked to at least one regulatory sequence, wherein said two or more artificial microRNA precursor can be on the same or separate transcriptional units, further wherein said sequence encoding artificial microRNA precursors is transcribed so that a transcript comprising said artificial miRNA precursors is produced, and wherein said transcript is processed so that mature miRNAs about 21 to 22 nts in length are excised from said artificial miRNA precursors, and expression of two or more plant fatty acid biosynthetic gene(s) selected from the group consisting of: fad2-1, fad2-2, fad3, fatB, sad, and faeI is inhibited.

Another embodiment of the instant invention includes a method for reducing expression two or more plant fatty acid biosynthetic gene, said method comprising:
  (a) transforming a plant cell with at least one isolated nucleic acid sequence comprising a sequence encoding two or more artificial microRNA precursors, wherein said two or more artificial microRNA precursors can be on the same or separate transcriptional units, operably linked to at least one regulatory sequence;
  (b) said at least one sequence encoding two or more artificial microRNA precursors is transcribed so that at least one transcript comprising said two or more artificial miRNA precursors is produced;
  (c) said at least one transcript is processed so that at least two or more mature miRNAs about 21 to 22 nts in length are excised from said artificial miRNA precursors, and
  (d) expression of two or more plant fatty acid biosynthetic genes selected from the group consisting of: fad2-1, fad2-2, fad3, fatB, sad, and faeI are reduced. Recombinant constructs and plant cells comprising the recombinant construct of the invention are also included. Dicot plant cells comprising the recombinant constructs of the invention are further embodiment. In another aspect, this invention concerns a method for reducing expression of at least one plant fatty acid biosynthetic gene in a plant cell, said method comprising:
  (a) transforming a plant cell with at least one isolated nucleic acid sequence comprising a sequence encoding an artificial microRNA precursor, operably linked to at least one regulatory sequence;
  (b) said at least one sequence encoding an artificial microRNA precursor is transcribed so that a transcript comprising said at least one artificial miRNA precursor is produced;
  (c) said transcript is processed so that at least one mature miRNA about 21 to 22 nts in length is excised from said artificial miRNA precursor, and
  (d) expression of at least one plant fatty acid biosynthetic gene selected from the group consisting of: fad2-1, fad2-2, fad3, fatB, sad, and faeI is reduced.

A further embodiment of the invention includes an isolated nucleic acid sequence comprising a sequence encoding at least one artificial microRNA precursor, operably linked to at least one regulatory sequence, wherein said sequence encoding at least one artificial microRNA precursor is capable of forming a double-stranded RNA or hairpin, wherein the at least one amiRNA precursor comprises at least one modified miRNA precursor in which the miRNA sequence and its complementary sequence are replaced by at least one amiRNA sequence and at least one STAR sequence, wherein expression of at least one plant fatty acid biosynthetic gene(s) selected from the group consisting of: fad2-1, fad2-2, fad3, fatB, sad, and faeI is inhibited.

A further embodiment of the invention comprises an isolated nucleic acid sequence comprising a sequence encoding
two or more artificial microRNA precursors, operably linked to at least one regulatory sequence, wherein said two or more artificial microRNA precursor can be on the same or separate transcriptional units, further wherein said sequences encoding two or more artificial microRNA precursors are capable of forming a double-stranded RNA or hairpin, wherein the two or more amiRNA precursors comprise a modified miRNA precursor(s) in which the miRNA sequence(s) and its complementary sequence(s) are replaced by two or more amiRNA sequences and two or more STAR sequences, and further wherein expression of at least two or more plant fatty acid biosynthetic genes selected from the group consisting of: fad2-1, fad2-2, fad3, fatB, sad, and faeI, are inhibited.

In yet another embodiment the instant invention included any of the isolated nucleic acid sequences of the instant invention, wherein the amiRNA sequence(s) comprise(s) at least one selected form the group consisting of: SEQ ID NO: 21, 22, 23, 24, 25, 80, 83, 86, 89, 92, 95, 98, and 101.

Transgenic plants or seed comprising these amiRNAs are also part of the invention and methods according to the invention that use these amiRNAs are also comprised by the instant invention.

Bioinformatic approaches have been successfully used to predict targets for plant miRNAs (Llave et al., *Plant Cell* 14:1605-1619 2002; Park et al., *Curr. Biol.* 12:1484-1495 2002; Rhoades et al., *Cell* 110:513-520 2002), and thus it appears that plant miRNAs have higher overall complementarity with their putative targets than do animal miRNAs. Most of these predicted target transcripts of plant miRNAs encode members of transcription factor families implicated in plant developmental patterning or cell differentiation.

General categories of sequences of interest include, for example, those genes involved in regulation or information, such as zinc fingers, transcription factors, homeotic genes, or cell cycle and cell death modulators, those involved in communication, such as kinases, and those involved in housekeeping, such as heat shock proteins.

Target sequences may include coding regions and non-coding regions such as promoters, enhancers, terminators, introns and the like.

The target sequence may be an endogenous sequence, or may be an introduced heterologous sequence, or transgene. For example, the methods may be used to alter the regulation or expression of a transgene, or to remove a transgene or other introduced sequence such as an introduced site-specific recombination site. The target sequence may also be a sequence from a pathogen, for example, the target sequence may be from a plant pathogen such as a virus, a mold or fungus, an insect, or a nematode. A miRNA could be expressed in a plant which, upon infection or infestation, would target the pathogen and confer some degree of resistance to the plant.

In plants, other categories of target sequences include genes affecting agronomic traits, insect resistance, disease resistance, herbicide resistance, sterility, grain characteristics, and commercial products. Genes of interest also included those involved in oil, starch, carbohydrate, or nutrient metabolism as well as those affecting, for example, kernel size, sucrose loading, and the like. The quality of grain is reflected in traits such as levels and types of oils, saturated and unsaturated, quality and quantity of essential amino acids, and levels of cellulose. For example, genes of the phytic acid biosynthetic pathway could be suppressed to generate a high available phosphorous phenotype. See, for example, phytic acid biosynthetic enzymes including inositol polyphosphate kinase-2 polynucleotides, disclosed in WO 02/059324, inositol 1,3,4-trisphosphate 5/6-kinase polynucleotides, disclosed in WO 03/027243, and myo-inositol 1-phosphate synthase and other phytate biosynthetic polynucleotides, disclosed in WO 99/05298, all of which are herein incorporated by reference. Genes in the lignification pathway could be suppressed to enhance digestibility or energy availability. Genes affecting cell cycle or cell death could be suppressed to affect growth or stress response. Genes affecting DNA repair and/or recombination could be suppressed to increase genetic variability. Genes affecting flowering time could be suppressed, as well as genes affecting fertility. Any target sequence could be suppressed in order to evaluate or confirm its role in a particular trait or phenotype, or to dissect a molecular, regulatory, biochemical, or proteomic pathway or network.

A number of promoters can be used. These promoters can be selected based on the desired outcome. It is recognized that different applications will be enhanced by the use of different promoters in plant expression cassettes to modulate the timing, location and/or level of expression of the miRNA. Such plant expression cassettes may also contain, if desired, a promoter regulatory region (e.g., one conferring inducible, constitutive, environmentally- or developmentally-regulated, or cell- or tissue-specific/selective expression), a transcription initiation start site, a ribosome binding site, an RNA processing signal, a transcription termination site, and/or a polyadenylation signal.

Constitutive, tissue-preferred or inducible promoters can be employed. Examples of constitutive promoters include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. If low level expression is desired, weak promoter(s) may be used. Weak constitutive promoters include, for example, the core promoter of the Rsyn7 promoter (WO 99/43838 and U.S. Pat. No. 6,072, 050), the core 35S CaMV promoter, and the like. Other constitutive promoters include, for example, U.S. Pat. Nos. 5,608,149; 5,608,144; 5,604,121; 5,569,597; 5,466,785; 5,399,680; 5,268,463; and 5,608,142. See also, U.S. Pat. No. 6,177,611, herein incorporated by reference.

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the ERE promoter which is estrogen induced, and the Axig1 promoter which is auxin induced and tapetum specific but also active in callus (PCT US01/22169).

Examples of promoters under developmental control include promoters that initiate transcription preferentially in certain tissues, such as leaves, roots, fruit, seeds, or flowers. An exemplary promoter is the anther specific promoter 5126 (U.S. Pat. Nos. 5,689,049 and 5,689,051). Examples of seed-preferred promoters include, but are not limited to, 27 kD gamma zein promoter and waxy promoter, Boronat, A. et al. (1986) *Plant Sci.* 47:95-102; Reina, M. et al. *Nucl. Acids Res.* 18(21):6426; and Kloesgen, R. B. et al. (1986) *Mol. Gen. Genet.* 203:237-244. Promoters that express in the embryo, pericarp, and endosperm are disclosed in U.S. Pat.

No. 6,225,529 and PCT publication WO 00/12733. The disclosures each of these are incorporated herein by reference in their entirety.

In some embodiments it will be beneficial to express the gene from an inducible promoter, particularly from a pathogen-inducible promoter. Such promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116. See also WO 99/43819, herein incorporated by reference.

Of interest are promoters that are expressed locally at or near the site of pathogen infection. See, for example, Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977. See also, Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant. Path.* 41:189-200).

Additionally, as pathogens find entry into plants through wounds or insect damage, a wound-inducible promoter may be used in the constructions of the polynucleotides. Such wound-inducible promoters include potato proteinase inhibitor (pin II) gene (Ryan (1990) *Ann. Rev. Phytopath.* 28:425-449; Duan et al. (1996) *Nature Biotech.* 14:494-498); wun1 and wun2, U.S. Pat. No. 5,428,148; win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Lett.* 323:73-76); MPI gene (Corderok et al. (1994) *Plant J.* 6(2):141-150); and the like, herein incorporated by reference.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression of a sequence of interest within a particular plant tissue. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen. Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol. Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590. In addition, the promoters of cab and rubisco can also be used. See, for example, Simpson et al. (1958) *EMBO J.* 4:2723-2729 and Timko et al. (1988) *Nature* 318:57-58. Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed rolC and rolD root-inducing genes of *Agrobacterium rhizogenes* (see *Plant Science* (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene, fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and rolB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179. The phaseolin gene (Murai et al. (1983) *Science* 23:476-482 and Sengopta-Gopalen et al. (1988) *PNAS* 82:3320-3324.

Transformation protocols as well as protocols for introducing nucleotide sequences into plants may vary depending on the type of plant or plant cell, i.e., monocot or dicot, targeted for transformation. Suitable methods of introducing the DNA construct include microinjection (Crossway et al. (1986) *Biotechniques* 4:320-334; and U.S. Pat. No. 6,300,543), sexual crossing, electroporation (Riggs et al. (1986) *Proc. Natl. Acad. Sci. USA* 83:5602-5606), *Agrobacterium*-mediated transformation (Townsend et al., U.S. Pat. No. 5,563,055; and U.S. Pat. No. 5,981,840), direct gene transfer (Paszkowski et al. (1984) *EMBO J.* 3:2717-2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in *Plant Cell, Tissue, and Organ Culture: Fundamental Methods*, ed. Gamborg and Phillips (Springer-Verlag, Berlin); and McCabe et al. (1988) *Biotechnology* 6:923-926). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); Tomes, U.S. Pat. No. 5,240,855; Buising et al., U.S. Pat. Nos. 5,322,783 and 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; Bowen et al., U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); and U.S. Pat. No. 5,736,369 (meristem transformation), all of which are herein incorporated by reference.

The nucleotide constructs may be introduced into plants by contacting plants with a virus or viral nucleic acids. Generally, such methods involve incorporating a nucleotide construct of the invention within a viral DNA or RNA molecule. Further, it is recognized that useful promoters encompass promoters utilized for transcription by viral RNA polymerases. Methods for introducing nucleotide constructs into plants and expressing a protein encoded therein, involving viral DNA or RNA molecules, are known in the art. See, for example, U.S. Pat. Nos. 5,889,191, 5,889,190, 5,866,785, 5,589,367 and 5,316,931; herein incorporated by reference.

In some embodiments, transient expression may be desired. In those cases, standard transient transformation techniques may be used. Such methods include, but are not limited to viral transformation methods, and microinjection of DNA or RNA, as well other methods well known in the art.

The cells from the plants that have stably incorporated the nucleotide sequence may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic imparted by the nucleotide sequence of interest and/or the genetic markers contained within the target site or transfer cassette. Two or more generations may be grown to ensure that expression of the desired phenotypic characteristic is stably maintained and inherited and then seeds harvested to ensure expression of the desired phenotypic characteristic has been achieved.

Fad2-1 and fad2-2 are fatty acid desaturases [Developmental and growth temperature regulation of two different microsomal .omega.-6 desaturase genes in soybeans. Heppard, Elmer P.; Kinney, Anthony J.; Stecca, Kevin L.; Miao, Guo-Hua. Agric. Products Dep., E. I. du Pont de Nemours Co., Wilmington, Del., USA. Plant Physiology (1996), 110 (1), 311-19.] gene families, also known as delta-12 desaturase or omega-6 desaturase (U.S. Pat. No. 6,872,872B1, U.S. Pat. No. 6,919,466B2, U.S. Pat. No. 7,105,721B2). FatB is a thioesterase encoding a palmitoyl-thioesterase (Kinney, A. J. (1997) Genetic engineering of oilseeds for desired traits. In: Genetic Engineering, Vol. 19, (Setlow J. K. Plenum Press, New York, N.Y., pp. 149-166.). Sad is a stearic acid desaturase and belongs to the Sad gene family, also known as delta-9 stearoyl-ACP desaturase (U.S. Pat. No. 7,498,427B2, U.S. Pat. No. 6,949,698B2). Fad3 belongs to the fatty acid desaturase 3 (fad3) gene family (U.S. Pat. No. 5,952,544 A). Fae1 is a fatty acid elongase (publication number US 2007/0204370 A1, filed Nov. 24, 2004).

EXAMPLES

Example 1

Artificial MicroRNA (amiRNA) Constructs for Silencing Soybean Fatty Acid Biosynthetic Genes Soy Fatty Acid Biosynthetic Genes Targeted for Silencing Key gene family sequences targeted for silencing in soybean are the stearic acid desaturase (Sad) gene family, also known as delta-9 stearoyl-ACP desaturase (U.S. Pat. No. 7,498,427B2, U.S. Pat. No. 6,949,698B2), the fatty acid desaturase 2-1 (Fad2-1) or 2-2 (fad2-2) [Developmental and growth temperature regulation of two different microsomal .omega.-6 desaturase genes in soybeans. Heppard, Elmer P.; Kinney, Anthony J.; Stecca, Kevin L.; Miao, Guo-Hua. Agric. Products Dep., E. I. du Pont de Nemours Co., Wilmington, Del., USA. Plant Physiology (1996), 110(1), 311-19.] gene families, also known as delta-12 desaturase or omega-6 desaturase (U.S. Pat. No. 6,872,872B1, U.S. Pat. No. 6,919,466B2, U.S. Pat. No. 7,105,721B2), the fatty acid desaturase 3 (fad3) gene family (U.S. Pat. No. 5,952,544 A) and the fatty acid thioesterase B (fatB) gene family, also known as palmitoyl-ACP thioesterase (U.S. Pat. No. 5,955,650 A, USRE37317E1). A list of fatty acid biosynthetic genes targeted for silencing by amiRNAs, along with corresponding soy genome sequence (Glyma) gene identifier, nt SEQ ID NO and aa SEQ ID NO are shown in Table 1.

TABLE 1

Soy Fatty Acid Biosynthetic Gene Sequences Targeted for Silencing

| Gene Family | Glyma Genes | nt SEQ ID NO | aa SEQ ID NO |
|---|---|---|---|
| GmFad2-1 | Glyma10g42470 | 1 | 2 |
|  | Glyma20g24530 | 3 | 4 |
| GmFad2-2 | Glyma19g32940 | 5 | 6 |
| GmSad | Glyma02g15600 | 7 | 8 |
|  | Glyma07g32850 | 9 | 10 |
| GmFad3 | Glyma14g37350 | 11 | 12 |
|  | Glyma02g39230 | 13 | 14 |
|  | Glyma18g06950 | 15 | 16 |
| GmFatB | Glyma05g08060 | 17 | 18 |
|  | Glyma17g12940 | 19 | 20 |

Design of Artificial MicroRNA Sequences

Artificial microRNAs (amiRNAs) that would have the ability to silence the desired target genes were designed largely according to rules described in Schwab R, et al. (2005) *Dev Cell* 8: 517-27. To summarize, microRNA sequences are 21 nucleotides in length, start at their 5'-end with a "U", display 5' instability relative to their star sequence which is achieved by including a C or G at position 19, and their 10th nucleotide is either an "A" or an "U". An additional requirement for artificial microRNA design was that the amiRNA have a high free delta-G as calculated using the ZipFold algorithm (Markham, N. R. & Zuker, M. (2005) *Nucleic Acids Res.* 33: W577-W581.).

Design and synthesis of amiRNA sequences for targeting the soy fad2-1 and fad2-2 genes was previously described in US20090155910A1 (WO 2009/079532) (the contents of which are incorporated by reference) and are shown in Table 2. New amiRNA sequences targeting soy fad3, fatB and sad genes were similarly designed and are also shown in Table 2.

TABLE 2 amiRNAs For Soy Fatty Acid Biosynthetic Gene Sequences Targeted for Silencing

| Gene Family | amiRNA | nt SEQ ID NO |
|---|---|---|
| GmFad2-1 | GM-MFAD2-1B | 21 |
| GmFad2-2 | GM-MFAD2-2 | 22 |
| GmSad | GM-MSAD3 | 23 |
| GmFad3 | GM-MFAD3C | 24 |
| FatB | GM-MFATBF | 25 |

Design of an Artificial Star Sequences

"Star sequences" are those that base pair with the amiRNA sequences, in the precursor RNA, to form imperfect stem structures. To form a perfect stem structure the star sequence would be the exact reverse complement of the amiRNA. The soybean precursor sequence as described in "Novel and nodulation-regulated microRNAs in soybean roots" Subramanian S, Fu Y, Sunkar R, Barbazuk W B, Zhu J K, Yu O BMC Genomics. 9:160 (2008) and accessed on mirBase (Conservation and divergence of microRNA families in plants" Dezulian T, Palatnik J F, Huson D H, Weigel D (2005) Genome Biology 6:P13) was folded using mfold (M. Zuker (2003) *Nucleic Acids Res.* 31: 3406-15; and D. H. Mathews, J. et al. (1999) *J. Mol. Biol.* 288: 911-940). The miRNA sequence was then replaced with the amiRNA sequence and the endogenous star sequence was replaced with the exact reverse complement of the amiRNA. Changes in the artificial star sequence were introduced so that the structure of the stem would remain the same as the endogenous structure. The altered sequence was then folded with mfold and the original and altered structures were compared by eye. If necessary, further alternations to the artificial star sequence were introduced to maintain the original structure.

Design and synthesis of STAR sequences that pair with amiRNAs for targeting the soy fad2-1 and fad2-2 genes was previously described in US20090155910A1 (WO 2009/079532) and are shown in Table 3. New STAR sequences that pair with amiRNAs for targeting the soy fad3, fatB and sad genes were similarly designed and are also shown in Table 3. STAR sequences differ for a given amiRNA with which they pair depending on the amiRNA precursor sequence used and this is also indicated in Table 3.

TABLE 3

Star Sequences For Soy Fatty Acid Biosynthetic Gene Sequences Targeted for Silencing

| Gene Family | STAR Sequence | nt SEQ ID NO |
|---|---|---|
| GmFad2-1 | 159-GM-MFAD2-1B | 26 |
|  | 396b-GM-MFAD2-1B | 27 |
| GmFad2-2 | 159-GM-MFAD2-2 | 28 |
| GmSad | 396b-GM-MSAD3 | 29 |
| GmFad3 | 159-GM-MFAD3C | 30 |
| FatB | 159-GM-FATBF | 31 |

Example 2

Prophetic

Conversion of Genomic MicroRNA Precursors to Artificial MicroRNA Precursors

Genomic miRNA precursor genes ("backbones"), such as those described in US20090155909A1 (WO 2009/079548) and in US20090155910A1 (WO 2009/079532), can be converted to amiRNAs using overlapping PCR, and the resulting DNAs can be completely sequenced and then cloned downstream of an appropriate promoter in a vector capable of transformation.

Alternatively, amiRNAs can be synthesized commercially, for example, by Codon Devices (Cambridge, Mass.), DNA 2.0 (Menlo Park, Calif.) or Genescript (Piscataway, N.J.). The synthesized DNA is then cloned downstream of an appropriate promoter in a vector capable of soybean transformation.

Artificial miRNAs can also be constructed using In-Fusion™ technology (Clontech, Mountain View, Calif.).

Example 3

Generation of amiRNA Precursors to Silence Soy Fatty Acid Biosynthetic Genes

The identification of the genomic miRNA precursor sequences 159 and 396b was described previously in US20090155910A1 (WO 2009/079532) and their sequences are set forth in SEQ ID NO: 152 and SEQ ID NO: 153, respectively.

Genomic miRNA precursor genes were converted to amiRNA precursors 159-fad2-1b, 396b-fad2-1b and 159-fad2-2 using overlapping PCR as previously described in US20090155910A1 (WO 2009/079532). Precursor amiRNA 159-fad2-1b and 396b-fad2-1b were then individually cloned downstream of the beta-conglycinin promoter in plasmid PHP27753 (also known as plasmid KS332, described in U.S. patent application Ser. No. 13/295,345, applicant's designation BB-1623 USCNT), to form expression constructs PHP32511 and PHP32510, respectively, as described in US20090155910A1. US20090155910A1 further describes the cloning of amiRNA precursor 159-fad2-2 downstream of either 396b-fad2-1b or 159-fad2-1b to produce PHP32843 and PHP32869, respectively. The SEQ ID NOs of sequences for precursor amiRNAs 159-fad2-1b, 396b-fad2-1b, 159-fad2-2 and 396b-fad2-1b/159-fad2-2, as well as plasmids PHP32511, PHP32510 and PHP32843 are shown in Table 4.

Genomic miRNA precursor gene 396b was converted to amiRNA precursor 396b-sad3 using overlapping PCR by the method previously described in US20090155910A1 (WO 2009/079532). amiRNA precursor 396b-sad3 was cloned 3' (downstream) of 396b-fad2-1b in expression vector PHP27753 to produce construct PHP33705. The SEQ ID NO of the sequence of precursor amiRNA 396b-sad3 and 396b-sad3/396b-fad2-1b, as well as plasmid PHP33705 is shown in Table 4.

Genomic miRNA precursor gene 159 was converted to amiRNA precursor 159-fad3c using overlapping PCR by the method previously described in US20090155910A1 (WO 2009/079532). amiRNA precursor 159-fad3c was cloned into expression vector PHP27753 to produce construct PHP38557. The SEQ ID NO of the sequence of precursor amiRNA 159-fad3c, as well as plasmid PHP38557 is shown in Table 4.

Genomic miRNA precursor gene 159 was converted to amiRNA precursor 159-fatBF using overlapping PCR by the method previously described in US20090155910A1 (WO 2009/079532). amiRNA precursor 159-fatBF was cloned into expression vector PHP27753 to produce construct PHP41103. The SEQ ID NO of the sequence of precursor amiRNA 159-fatb, as well as plasmid PHP41103 is shown in Table 4.

The NotI fragment of PHP38557, containing the amiRNA precursor 159-fad3c, was cloned into the NotI site of vector PKR72, described in U.S. Pat. No. 8,049,062, to produce construct pKR1756. The SEQ ID NO of the sequence of precursor amiRNA 159-fad3c, as well as plasmid pKR1756 is shown in Table 4.

The NotI fragment of PHP41103, containing the amiRNA precursor 159-fatBF, was cloned into the NotI site of vector PKR72, described in U.S. Pat. No. 8,049,062, to produce construct pKR1757. The SEQ ID NO of the sequence of precursor amiRNA 159-fatb, as well as plasmid pKR1757 is shown in Table 4.

amiRNA precursors 159-fad3c and 159-fatBF were generated as described above and cloned together (in that order) downstream of the beta-conglycinin promoter into expression vector PKR72, described in U.S. Pat. No. 8,049,062, to produce construct pKR1766. The SEQ ID NO of the sequence of precursor amiRNA 159-fad3c/159-fatBF, as well as plasmid pKR1766 is shown in Table 4.

amiRNA precursors 159-fatBF and 159-fad3c were generated as described above and cloned together (in that order) downstream of the beta-conglycinin promoter into expression vector PKR72, described in U.S. Pat. No. 8,049,062, to produce construct pKR1771. The SEQ ID NO of the sequence of precursor amiRNA 159-fatBF/159-fad3c, as well as plasmid pKR1771 is shown in Table 4.

amiRNA precursors 159-fad2-1b, 159-fatBF and 159-fad3c were generated as described above and cloned together (in that order) into expression vector PHP27753 to produce construct PHP41784. The SEQ ID NO of the sequence of precursor amiRNA 159-fad2-1b/159-fatBF/159-fad3c, as well as plasmid PHP41784 is shown in Table 4.

amiRNA precursors 396b-fad2-1b, 159-fatBF and 159-fad3c were generated as described above and cloned together (in that order) downstream of the beta-conglycinin promoter into expression vector PKR72, described in U.S. Pat. No. 8,049,062, to produce construct pKR1776. The SEQ ID NO of the sequence of precursor amiRNA 396b-fad2-1b1159-fatBF/159-fad3c, as well as plasmid pKR1776 is shown in Table 4.

TABLE 4

Precursor amiRNAs and amiRNA Expression Constructs For Soy Fatty Acid Biosynthetic Gene Sequences Targeted for Silencing

| Gene Family | amiRNA Precursor | amiRNA Precursor SEQ ID NO | Plasmid Name | Plasmid SEQ ID NO |
|---|---|---|---|---|
| GmFad2-1 | 159-fad2-1b | 124 | PHP32511 | 32 |
| GmFad2-1 | 396b-fad2-1b | 125 | PHP32510 | 33 |
| GmFad2-2 | 159-fad2-2 | 126 | — | — |
| GmFad2-1 & GmFad2-2 | 396b-fad2-1b/159-fad2-2 | 127 | PHP32843 | 34 |
| GmSad | 396b-sad3 | 128 | — | — |
| GmFad2-1 & GmSad | 396b-fad2-1b/396b-sad3 | 129 | PHP33705 | 35 |
| GmFad3 | 159-fad3c | 130 | PHP38557 | 36 |
| GmFatB | 159-fatBF | 131 | PHP41103 | 37 |
| GmFad3 | 159-fad3c | 130 | pKR1756 | 38 |
| GmFatB | 159-fatBF | 131 | pKR1757 | 39 |
| GmFad3 & GmFatB | 159-fad3c/159-fatBF | 132 | pKR1766 | 40 |
| GmFatB & GmFad3 | 159-fatBF/159-fad3c | 133 | pKR1771 | 41 |
| GmFad2-1 & GmFatB & GmFad3 | 159-fad2-1b/159-fatBF/159-fad3c | 134 | PHP41784 | 42 |
| GmFad2-1 & GmFatB & GmFad3 | 396b-fad2-1b/159-fatB/159-fad3c | 135 | pKR1776 | 43 |

From Table 4, the amiRNA precursor 159-fad2-1b (SEQ ID NO: 124) is 958 nt in length and is substantially similar to the deoxyribonucleotide sequence set forth in SEQ ID NO: 152 wherein nucleotides 276 to 296 of SEQ ID NO: 152 are replaced by GM-MFAD2-1B amiRNA (SEQ ID NO: 21) and wherein nucleotides 121 to 141 of SEQ ID NO: 152 are replaced by 159-GM-MFAD2-1B Star Sequence (SEQ ID NO: 26).

From Table 4, the amiRNA precursor 396b-fad2-1b (SEQ ID NO: 125) is 574 nt in length and is substantially similar to the deoxyribonucleotide sequence set forth in SEQ ID NO: 153 wherein nucleotides 196 to 216 of SEQ ID NO: 152 are replaced 15 by GM-MFAD2-1 B ami RNA (SEQ ID NO: 21) and wherein nucleotides 262 to 282 of SEQ ID NO: 153 are replaced by 396b-GM-MFAD2-1 B Star Sequence (SEQ ID NO: 26).

From Table 4, the amiRNA precursor 159-fad2-2 (SEQ ID NO: 126) is 958 nt in length and is substantially similar to the deoxyribonucleotide sequence set forth in SEQ ID NO: 152 wherein nucleotides 276 to 296 of SEQ ID NO: 152 are replaced by GM-MFAD2-2 amiRNA (SEQ ID NO: 22) and wherein nucleotides 121 to 141 of SEQ ID NO: 152 are replaced by 159-GM-MFAD2-2 Star Sequence (SEQ ID NO: 28).

From Table 4, the amiRNA precursor 396b-fad2-1b/159-fad2-2 (SEQ ID NO: 127), which combines amiRNA precursors 396b-fad2-1b (SEQ ID NO: 126) and 159-fad2-2 (SEQ ID NO: 127) into one transcriptional unit, is 1568 nt in length and is substantially similar to the deoxyribonucleotide sequence set forth in SEQ ID NO: 153 (from nt 1 to 574 of 396b-fad2-1b/159-fad2-2) wherein nucleotides 196 to 216 of SEQ ID NO: 152 are replaced by GM-MFAD2-1B amiRNA (SEQ ID NO: 21) and wherein nucleotides 262 to 282 of SEQ ID NO: 153 are replaced by 396b-GM-MFAD2-1B Star Sequence (SEQ ID NO: 26). The amiRNA precursor 396b-fad2-1b/159-fad2-2 (SEQ ID NO: 127) is also, substantially similar to the deoxyribonucleotide sequence set forth in SEQ ID NO: 152 (from nt 611 to 1568 of 396b-fad2-1b/159-fad2-2) wherein nucleotides 276 to 296 of SEQ ID NO: 152 are replaced by GM-MFAD2-2 amiRNA (SEQ ID NO: 22) and wherein nucleotides 121 to 141 of SEQ ID NO: 152 are replaced by 159-GM-MFAD2-2 Star Sequence (SEQ ID NO: 28). In amiRNA precursor 396b-fad2-1b/159-fad2-2, nt 575 to 610 are derived from cloning.

From Table 4, the amiRNA precursor 396b-sad3 (SEQ ID NO: 128) is 574 nt in length and is substantially similar to the deoxyribonucleotide sequence set forth in SEQ ID NO: 153 wherein nucleotides 196 to 216 of SEQ ID NO: 152 are replaced by GM-MSAD3 amiRNA (SEQ ID NO: 23) and wherein nucleotides 262 to 282 of SEQ ID NO: 153 are replaced by GM-MSAD3 amiRNA Star Sequence (SEQ ID NO: 29).

From Table 4, the amiRNA precursor 396b-fad2-1b/396b-sad3 (SEQ ID NO: 129), which combines amiRNA precursors 396b-fad2-1b (SEQ ID NO: 126) and 396b-sad3 (SEQ ID NO: 128) into one transcriptional unit, is 1184 nt in length and is substantially similar to the deoxyribonucleotide sequence set forth in SEQ ID NO: 153 (from nt 1 to 574 of 396b-fad2-1b/396b-sad3) wherein nucleotides 196 to 216 of SEQ ID NO: 152 are replaced by GM-MFAD2-1B amiRNA (SEQ ID NO: 21) and wherein nucleotides 262 to 282 of SEQ ID NO: 153 are replaced by 396b-GM-MFAD2-1B Star Sequence (SEQ ID NO: 26). The amiRNA precursor 396b-fad2-1b/396b-sad3 (SEQ ID NO: 129) is also, substantially similar to the deoxyribonucleotide sequence set forth in SEQ ID NO: 153 (from nt 611 to 1184 of 396b-fad2-1b/396b-sad) wherein nucleotides 196 to 216 of SEQ ID NO: 153 are replaced by GM-MSAD3 amiRNA (SEQ ID NO: 23) and wherein nucleotides 262 to 282 of SEQ ID NO: 153 are replaced by GM-MSAD3 Star Sequence (SEQ ID NO: 29). In amiRNA precursor 396b-fad2-1b/396b-sad3, nt 575 to 610 are derived from cloning.

From Table 4, the amiRNA precursor 159-fad3c (SEQ ID NO: 130) is 958 nt in length and is substantially similar to the deoxyribonucleotide sequence set forth in SEQ ID NO: 152 wherein nucleotides 276 to 296 of SEQ ID NO: 152 are replaced by GM-MFAD3C amiRNA (SEQ ID NO: 24) and wherein nucleotides 121 to 141 of SEQ ID NO: 152 are replaced by GM-MFAD3C Star Sequence (SEQ ID NO: 30).

From Table 4, the amiRNA precursor 159-fatBF (SEQ ID NO: 131) is 958 nt in length and is substantially similar to the deoxyribonucleotide sequence set forth in SEQ ID NO: 152 wherein nucleotides 276 to 296 of SEQ ID NO: 152 are replaced by GM-MFATBF amiRNA (SEQ ID NO: 25) and wherein nucleotides 121 to 141 of SEQ ID NO: 152 are replaced by GM-MFATBF Star Sequence (SEQ ID NO: 31).

From Table 4, the amiRNA precursor 159-fad3c/159-fatBF (SEQ ID NO: 132), which combines amiRNA precursors 159-fad3c (SEQ ID NO: 130) and 159-fatBF (SEQ ID NO: 131) into one transcriptional unit, is 1924 nt in length and is substantially similar to the deoxyribonucleotide sequence set forth in SEQ ID NO: 152 (from nt 1 to 958 of 159-fad3c/159-fatBF) wherein nucleotides 276 to 296 of SEQ ID NO: 152 are replaced by GM-MFAD3C amiRNA (SEQ ID NO: 24) and wherein nucleotides 121 to 141 of SEQ ID NO: 152 are replaced by GM-MFAD3C Star Sequence (SEQ ID NO: 30). The amiRNA precursor 159-fad3c/159-fatBF (SEQ ID NO: 132) is also, substantially similar to the deoxyribonucleotide sequence set forth in SEQ ID NO: 152 (from nt 967 to 1924 of 159-fad3c/159-fatBF) wherein nucleotides 276 to 296 of SEQ ID NO: 152 are replaced by GM-MFATBF amiRNA (SEQ ID NO: 25) and wherein nucleotides 121 to 141 of SEQ ID NO: 152 are replaced by 159-GM-MFATBF Star Sequence (SEQ ID NO: 31). In amiRNA precursor 159-fad3c/159-fatBF, nt 959 to 966 are derived from cloning.

From Table 4, the amiRNA precursor 159-fatBF/159-fad3c (SEQ ID NO: 133), which combines amiRNA precursors 159-fatBF (SEQ ID NO: 131) and 159-fad3c (SEQ ID NO: 130) into one transcriptional unit, is 1924 nt in length and is substantially similar to the deoxyribonucleotide sequence set forth in SEQ ID NO: 152 (from nt 1 to 958 of 159-fatBF/159-fad3c) wherein nucleotides 276 to 296 of SEQ ID NO: 152 are replaced by GM-MFATBF amiRNA (SEQ ID NO: 25) and wherein nucleotides 121 to 141 of SEQ ID NO: 152 are replaced by GM-MFATBF Star Sequence (SEQ ID NO: 31). The amiRNA precursor 159-fatBF/159-fad3c (SEQ ID NO: 133) is also, substantially similar to the deoxyribonucleotide sequence set forth in SEQ ID NO: 152 (from nt 967 to 1924 of 159-fatBF/159-fad3c) wherein nucleotides 276 to 296 of SEQ ID NO: 152 are replaced by GM-MFAD3C amiRNA (SEQ ID NO: 24) and wherein nucleotides 121 to 141 of SEQ ID NO: 152 are replaced by GM-MFAD3C Star Sequence (SEQ ID NO: 30). In amiRNA precursor 159-fatBF/159-fad3c, nt 959 to 966 are derived from cloning.

From Table 4, the amiRNA precursor 159-fad2-1b/159-fatBF/159-fad3c (SEQ ID NO: 134), which combines amiRNA precursors 159-fad2-1b (SEQ ID NO: 124), 159-fatBF (SEQ ID NO: 131) and 159-fad3c (SEQ ID NO: 130) into one transcriptional unit, is 2886 nt in length and is substantially similar to the deoxyribonucleotide sequence set forth in SEQ ID NO: 152 (from nt 1 to 958 of 159-fad2-1b/159-fatBF/159-fad3c) wherein nucleotides 276 to 296 of SEQ ID NO: 152 are replaced by GM-MFAD2-1B amiRNA (SEQ ID NO: 21) and wherein nucleotides 121 to 141 of SEQ ID NO: 152 are replaced by 159-GM-MFAD2-1B Star Sequence (SEQ ID NO: 26). The amiRNA precursor 159-fad2-1b/159-fatBF/159-fad3c (SEQ ID NO: 134) is also, substantially similar to the deoxyribonucleotide sequence set forth in SEQ ID NO: 152 (from nt 965 to 1922 of 159-fad2-1b/159-fatBF/159-fad3c) wherein nucleotides 276 to 296 of SEQ ID NO: 152 are replaced by GM-MFATBF amiRNA (SEQ ID NO: 25) and wherein nucleotides 121 to 141 of SEQ ID NO: 152 are replaced by GM-MFATBF Star Sequence (SEQ ID NO: 31). The amiRNA precursor 159-fad2-1b/159-fatBF/159-fad3c (SEQ ID NO: 134) is also, substantially similar to the deoxyribonucleotide sequence set forth in SEQ ID NO: 152 (from nt 1929 to 2886 of 159-fad2-1b/159-fatBF/159-fad3c) wherein nucleotides 276 to 296 of SEQ ID NO: 152 are replaced by GM-MFAD3C amiRNA (SEQ ID NO: 24) and wherein nucleotides 121 to 141 of SEQ ID NO: 152 are replaced by GM-MFAD3C Star Sequence (SEQ ID NO: 30). In amiRNA precursor 159-fad2-1b/159-fatBF/159-fad3c (SEQ ID NO: 134), nt 959 to 964 and 1923 to 1928 are derived from cloning.

From Table 4, the amiRNA precursor 396b-fad2-1b/159-fatBF/159-fad3c (SEQ ID NO: 135), which combines amiRNA precursors 396b-fad2-1b (SEQ ID NO: 125), 159-fatBF (SEQ ID NO: 131) and 159-fad3c (SEQ ID NO: 130) into one transcriptional unit, is 2543 nt in length and is substantially similar to the deoxyribonucleotide sequence set forth in SEQ ID NO: 153 (from nt 1 to 574 of 396b-fad2-1b/159-fatBF/159-fad3c) wherein nucleotides 196 to 216 of SEQ ID NO: 152 are replaced by GM-MFAD2-1B amiRNA (SEQ ID NO: 21) and wherein nucleotides 262 to 282 of SEQ ID NO: 153 are replaced by 396b-GM-MFAD2-1B Star Sequence (SEQ ID NO: 26). The amiRNA precursor 396b-fad2-1b/159-fatBF/159-fad3c (SEQ ID NO: 135) is also, substantially similar to the deoxyribonucleotide sequence set forth in SEQ ID NO: 152 (from nt 620 to 1577 of 396b-fad2-1b/159-fatBF/159-fad3c) wherein nucleotides 276 to 296 of SEQ ID NO: 152 are replaced by GM-MFATBF amiRNA (SEQ ID NO: 25) and wherein nucleotides 121 to 141 of SEQ ID NO: 152 are replaced by GM-MFATBF Star Sequence (SEQ ID NO: 31). The amiRNA precursor 396b-fad2-1b/159-fatBF/159-fad3c (SEQ ID NO: 135) is also, substantially similar to the deoxyribonucleotide sequence set forth in SEQ ID NO: 152 (from nt 1586 to 2543 of 396b-fad2-1b/159-fatBF/159-fad3c) wherein nucleotides 276 to 296 of SEQ ID NO: 152 are replaced by GM-MFAD3C amiRNA (SEQ ID NO: 24) and wherein nucleotides 121 to 141 of SEQ ID NO: 152 are replaced by GM-MFAD3C Star Sequence (SEQ ID NO: 30). In amiRNA precursor 396b-fad2-1b/159-fatBF/159-fad3c (SEQ ID NO: 135), nt 575 to 619 and 1578 to 1585 are derived from cloning.

Example 4

Expression of amiRNAs for Silencing Soy Fatty Acid Biosynthetic Genes in Soybean Somatic Embryos Plasmids pKR1756 (SEQ ID NO: 38), pKR1757 (SEQ ID NO: 39), pKR1766 (SEQ ID NO: 40), pKR1771 (SEQ ID NO: 41) and pKR1776 (SEQ ID NO: 43) were transformed into soybean embryogenic suspension cultures (cv. Jack or 93B86) as described below.

Soybean Embryogenic Suspension Culture Initiation:

Soybean cultures were initiated twice each month with 5-7 days between each initiation. Pods with immature seeds from available soybean plants 45-55 days after planting were picked, removed from their shells and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water and those less than 4 mm were placed on individual microscope slides. The small end of the seed was cut and the cotyledons pressed out of the seed coat. Cotyledons were transferred to plates containing SB199 medium (25-30 cotyledons per plate) for 2 weeks, then transferred to SB1 for 2-4 weeks. Plates were wrapped with fiber tape. After this time, secondary embryos were cut and placed into SB196 liquid media for 7 days.

Culture Conditions

Soybean embryogenic suspension cultures (cv. Jack) were maintained in 35 mL liquid medium SB196 (infra) on a rotary shaker, 150 rpm, 26° C. with cool white fluorescent lights on 16:8 h day/night photoperiod at light intensity of 60-85 µE/m2/s. Cultures were subcultured every 7 days to two weeks by inoculating approximately 35 mg of tissue into 35 mL of fresh liquid SB196 (the preferred subculture interval is every 7 days).

Preparation of DNA for Bombardment:

Plasmids pKR1756 (SEQ ID NO: 38), pKR1757 (SEQ ID NO: 39), pKR1766 (SEQ ID NO: 40), pKR1771 (SEQ ID NO: 41) and pKR1776 (SEQ ID NO: 43) were prepared for transformation in the following way.

A 50 µL aliquot of sterile distilled water containing 1 mg of gold particles was added to 5 µL of a 1 µg/µL DNA solution, 50 µL 2.5M $CaCl_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Soybean embryogenic suspension cultures were transformed by the method of particle gun bombardment (Klein et al., *Nature* 327:70 (1987)) using a DuPont Biolistic PDS1000/HE instrument (helium retrofit) for all transformations.

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were cultured for one-three weeks at 26° C. in SB196 under cool white fluorescent (Phillips cool white Econowatt F40/CW/RS/EW) and Agro (Phillips F40 Agro) bulbs (40 watt) on a 16:8 hrphotoperiod with light intensity of 90-120 µE/m²s. Embryo clusters were removed to SB228 (SHaM) liquid media, 35 mL in 250 mL Erlenmeyer flask, for 2-3 weeks. Tissue cultured in SB228 was maintained on a rotary shaker, 130 rpm, 26° C. with cool white fluorescent lights on 16:8 h day/night photoperiod at light intensity of 60-85 µE/m2/s. During this period, individual embryos were removed from the clusters and screened for alterations in their fatty acid compositions as described supra. Media Recipes:

| SB 196 - FN Lite Liquid Proliferation Medium (per liter) | |
|---|---|
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |

-continued

| | |
|---|---|
| $KNO_3$ | 2.83 gm |
| $(NH_4)_2SO_4$ | 0.463 gm |
| Asparagine | 1.0 gm |
| Sucrose (1%) | 10 gm |
| pH 5.8 | |

| FN Lite Stock Solutions | | | |
|---|---|---|---|
| Stock Number | | 1000 mL | 500 mL |
| 1 | MS Fe EDTA 100x Stock | | |
| | $Na_2$ EDTA* | 3.724 g | 1.862 g |
| | $FeSO_4$—$7H_2O$ | 2.784 g | 1.392 g |
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

SB1 Solid Medium (per liter)

1 package MS salts (Gibco/BRL - Cat. No. 11117-066)
1 mL B5 vitamins 1000X stock
31.5 g Glucose
2 mL 2,4-D (20 mg/L final concentration)
pH 5.7
8 g TC agar
SB199 Solid Medium (per liter)

1 package MS salts (Gibco/BRL - Cat. No. 11117-066)
1 mL B5 vitamins 1000X stock
30 g Sucrose
4 ml 2,4-D (40 mg/L final concentration)
pH 7.0
2 gm Gelrite
SB 166 Solid Medium (per liter)

1 package MS salts (Gibco/BRL - Cat. No. 11117-066)
1 mL B5 vitamins 1000X stock
60 g maltose
750 mg $MgCl_2$ hexahydrate
5 g Activated charcoal
pH 5.7
2 g Gelrite
SB 103 Solid Medium (per liter)

1 package MS salts (Gibco/BRL - Cat. No. 11117-066)
1 mL B5 vitamins 1000X stock
60 g maltose
750 mg MgCl2 hexahydrate
pH 5.7
2 g Gelrite
SB 71-4 Solid Medium (per liter)

1 bottle Gamborg's B5 salts w/ sucrose
(Gibco/BRL - Cat. No. 21153-036)
pH 5.7
5 g TC agar
2,4-D Stock Obtain premade from Phytotech Cat. No. D 295 - concentration 1 mg/mL
B5 Vitamins Stock (per 100 mL)

Store aliquots at −20° C.
10 g Myo-inositol
100 mg Nicotinic acid
100 mg Pyridoxine HCl
1 g Thiamine

*Add first, dissolve in dark bottle while stirring

If the solution does not dissolve quickly enough, apply a low level of heat via the hot stir plate.

| SB 228 - Soybean Histodifferentiation & Maturation (SHaM) (per liter) | |
|---|---|
| DDI H2O | 600 ml |
| FN-Lite Macro Salts for SHaM 10X | 100 ml |
| MS Micro Salts 1000x | 1 ml |
| MS FeEDTA 100x | 10 ml |
| CaCl 100x | 6.82 ml |
| B5 Vitamins 1000x | 1 ml |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≤30 C): | |
| *Glutamine (Final conc. 30 mM) 4% | 110 mL |

*Note: Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

| FN-lite Macro for SHAM 10X - Stock #1 (per liter) | |
|---|---|
| $(NH_4)2SO_4$ (Ammonium Sulfate) | 4.63 g |
| $KNO_3$ (Potassium Nitrate) | 28.3 g |
| $MgSO_4*7H_20$ (Magnesium Sulfate Heptahydrate) | 3.7 g |
| $KH_2PO_4$ (Potassium Phosphate, Monobasic) | 1.85 g |
| Bring to volume | |
| Autoclave | |

| MS Micro 1000X - Stock #2 (per 1 liter) | |
|---|---|
| $H_3BO_3$ (Boric Acid) | 6.2 g |
| $MnSO_4*H_2O$ (Manganese Sulfate Monohydrate) | 16.9 g |
| $ZnSO4*7H20$ (Zinc Sulfate Heptahydrate) | 8.6 g |
| $Na_2MoO_4*2H20$ (Sodium Molybdate Dihydrate) | 0.25 g |
| $CuSO_4*5H_20$ (Copper Sulfate Pentahydrate) | 0.025 g |
| $CoCl_2*6H_2O$ (Cobalt Chloride Hexahydrate) | 0.025 g |
| KI (Potassium Iodide) | 0.8300 g |
| Bring to volume | |
| Autoclave | |

| FeEDTA 100X - Stock #3 (per liter) | |
|---|---|
| $Na_2EDTA$* (Sodium EDTA) | 3.73 g |
| $FeSO_4*7H_2O$ (Iron Sulfate Heptahydrate) | 2.78 g |
| *EDTA must be completely dissolved before adding iron. | |
| Bring to Volume | |
| Solution is photosensitive. Bottle(s) should be wrapped in foil to omit light. | |
| Autoclave | |

| Ca 100X - Stock #4 (per liter) | |
|---|---|
| $CaCl_2*2H_20$ (Calcium Chloride Dihydrate) | 44 g |
| Bring to Volume | |
| Autoclave | |

| B5 Vitamin 1000X - Stock #5 (per liter) | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

| 4% Glutamine - Stock #6 (per liter) | |
|---|---|
| DDI water heated to 30° C. | 900 ml |
| L-Glutamine | 40 g |
| Gradually add while stirring and applying low heat. | |
| Do not exceed 35° C. | |
| Bring to Volume | |
| Filter Sterilize | |
| Store frozen* | |

*Note: Warm thawed stock in 31° C. bath to fully dissolve crystals.

Functional Analysis in Somatic Soybean Embryos

Mature somatic soybean embryos are a good model for zygotic embryos. While in the globular embryo state in liquid culture, somatic soybean embryos contain very low amounts of triacylglycerol (TAG) or storage proteins typical of maturing, zygotic soybean embryos. At this developmental stage, the ratio of total triacylglyceride to total polar lipid (phospholipids and glycolipid) is about 1:4, as is typical of zygotic soybean embryos at the developmental stage from which the somatic embryo culture was initiated. At the globular stage as well, the mRNAs for the prominent seed proteins, α'-subunit of β-conglycinin, kunitz trypsin inhibitor 3, and seed lectin are essentially absent. Upon transfer to hormone-free media to allow differentiation to the maturing somatic embryo state, TAG becomes the most abundant lipid class. As well, mRNAs for α'-subunit of β-conglycinin, kunitz trypsin inhibitor 3 and seed lectin become very abundant messages in the total mRNA population. On this basis, the somatic soybean embryo system behaves very similarly to maturing zygotic soybean embryos in vivo, and is thus a good and rapid model system for analyzing the phenotypic effects of modifying the expression of genes in the fatty acid biosynthesis pathway (see PCT Publication No. WO 2002/00904). The model system is also predictive of the fatty acid composition of seeds from plants derived from transgenic embryos.

Fatty Acid Analysis:

Somatic embryos were harvested after two weeks of culture in the liquid maturation medium SB228 (SHaM) liquid media. Approximately 30 events were created in transformations with plasmids pKR1756 (SEQ ID NO: 38), pKR1757 (SEQ ID NO: 39), pKR1766 (SEQ ID NO: 40), pKR1771 (SEQ ID NO: 41) and pKR1776 (SEQ ID NO: 43), having experiment names MSE2887, MSE2888, MSE2889, MSE2890 and MSE2723, respectively.

All embryos generated for a given event were harvested in bulk and processed as follows. Approximately 10-20 embryos were frozen by incubation in a −80° C. freezer for 24 h followed by lyophilization for 48 h.

Dried embryos were ground to a fine powder using a genogrinder vial (½"×2" polycarbonate) and a steel ball (SPEX Centriprep (Metuchen, N.J., U.S.A.). Grinding time was 30 sec at 1450 oscillations per min.

Lipids from approximately 20-50 mg of dried embryo powder were transesterified to fatty acid methyl esters (FAME) and analyzed by GC as described in PCT Publication No. WO 2008/147935.

Briefly, 50 µL of trimethylsulfonium hydroxide (TMSH) reagent and 0.5 mL of hexane were added to the dried embryo powder in glass GC vials and incubated for 30 min at room temperature while shaking. Fatty acid methyl esters (1 µL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.).

The resulting fatty acid profiles for events from MSE2887, MSE2888, MSE2889, MSE2890 and MSE2723 are summarized in TABLE 5. In TABLE 5, fatty acids are identified as 16:0 (palmitate), 18:0 (stearic acid), 18:1 (oleic acid), 18:2 (linoleic acid) and 18:3 (alpha-linolenic acid) and are expressed as a weight percent (wt. %) of total fatty acids. For MSE2887 and MSE2889 results are sorted for 18:3 in ascending order. For MSE2888, MSE2890 and MSE2723, results are sorted for 16:0 in ascending order. The average fatty acid profile for all events for each experiment is shown as avg.

TABLE 5

Fatty Acid Profiles For MSE2887, MSE2888, MSE2889, MSE2890 and MSE2723

| Event | Construct | amiRNAs | 16:0 | 18:0 | 18:1 | 18:2 | 18:3 |
|---|---|---|---|---|---|---|---|
| MSE2887-12 | pKR1756 | fad3 | 16.8 | 5.5 | 19.4 | 53.1 | 5.1 |
| MSE2887-8 | pKR1756 | fad3 | 16.2 | 5.9 | 22.0 | 50.5 | 5.5 |
| MSE2887-24 | pKR1756 | fad3 | 17.2 | 7.2 | 23.5 | 46.6 | 5.5 |
| MSE2887-13 | pKR1756 | fad3 | 17.7 | 5.5 | 20.0 | 51.1 | 5.8 |
| MSE2887-23 | pKR1756 | fad3 | 17.7 | 5.8 | 21.2 | 49.1 | 6.2 |
| MSE2887-30 | pKR1756 | fad3 | 17.0 | 6.4 | 21.6 | 47.4 | 7.6 |
| MSE2887-28 | pKR1756 | fad3 | 17.9 | 6.0 | 15.1 | 53.4 | 7.6 |
| MSE2887-9 | pKR1756 | fad3 | 17.3 | 5.7 | 20.2 | 48.8 | 8.0 |
| MSE2887-29 | pKR1756 | fad3 | 16.5 | 4.7 | 15.1 | 55.5 | 8.1 |
| MSE2887-25 | pKR1756 | fad3 | 16.6 | 5.1 | 19.4 | 50.6 | 8.2 |
| MSE2887-16 | pKR1756 | fad3 | 17.6 | 5.9 | 19.4 | 48.7 | 8.4 |
| MSE2887-6 | pKR1756 | fad3 | 17.1 | 5.3 | 18.9 | 49.8 | 8.9 |
| MSE2887-11 | pKR1756 | fad3 | 16.0 | 6.6 | 21.3 | 46.6 | 9.5 |
| MSE2887-18 | pKR1756 | fad3 | 16.3 | 6.1 | 21.7 | 45.8 | 10.0 |
| MSE2887-27 | pKR1756 | fad3 | 16.2 | 7.1 | 23.8 | 42.6 | 10.2 |
| MSE2887-19 | pKR1756 | fad3 | 16.5 | 4.9 | 20.2 | 47.0 | 11.4 |
| MSE2887-31 | pKR1756 | fad3 | 17.4 | 5.8 | 17.6 | 47.6 | 11.5 |
| MSE2887-2 | pKR1756 | fad3 | 16.4 | 5.2 | 18.9 | 46.9 | 12.6 |
| MSE2887-22 | pKR1756 | fad3 | 17.4 | 5.9 | 20.1 | 43.5 | 13.1 |
| MSE2887-14 | pKR1756 | fad3 | 16.2 | 6.3 | 21.1 | 43.3 | 13.2 |
| MSE2887-4 | pKR1756 | fad3 | 14.2 | 5.4 | 21.9 | 45.0 | 13.4 |
| MSE2887-17 | pKR1756 | fad3 | 16.6 | 4.9 | 13.4 | 51.3 | 13.8 |

TABLE 5-continued

Fatty Acid Profiles For MSE2887, MSE2888, MSE2889, MSE2890 and MSE2723

| Event | Construct | amiRNAs | 16:0 | 18:0 | 18:1 | 18:2 | 18:3 |
|---|---|---|---|---|---|---|---|
| MSE2887-1 | pKR1756 | fad3 | 17.5 | 5.0 | 17.0 | 46.4 | 14.1 |
| MSE2887-26 | pKR1756 | fad3 | 17.7 | 5.4 | 14.1 | 48.1 | 14.7 |
| MSE2887-21 | pKR1756 | fad3 | 17.8 | 6.0 | 17.3 | 43.6 | 15.4 |
| MSE2887-20 | pKR1756 | fad3 | 17.9 | 5.1 | 12.1 | 49.2 | 15.6 |
| MSE2887-15 | pKR1756 | fad3 | 17.9 | 6.4 | 16.5 | 43.6 | 15.7 |
| MSE2887-10 | pKR1756 | fad3 | 17.3 | 4.8 | 16.9 | 45.2 | 15.7 |
| MSE2887-5 | pKR1756 | fad3 | 17.6 | 5.2 | 18.5 | 42.7 | 16.1 |
| MSE2887-3 | pKR1756 | fad3 | 18.4 | 4.8 | 14.4 | 45.5 | 16.8 |
| MSE2887-7 | pKR1756 | fad3 | 16.5 | 5.1 | 18.4 | 41.9 | 18.1 |
| Avg. | | | 17.0 | 5.6 | 18.7 | 47.4 | 11.2 |
| MSE2888-12 | pKR1757 | fatBF | 4.7 | 3.6 | 22.9 | 56.7 | 12.1 |
| MSE2888-30 | pKR1757 | fatBF | 5.3 | 3.7 | 22.0 | 56.9 | 12.2 |
| MSE2888-27 | pKR1757 | fatBF | 6.1 | 5.4 | 28.0 | 46.9 | 13.5 |
| MSE2888-26 | pKR1757 | fatBF | 6.6 | 4.3 | 22.4 | 55.3 | 11.4 |
| MSE2888-22 | pKR1757 | fatBF | 6.8 | 4.6 | 21.5 | 54.5 | 12.7 |
| MSE2888-28 | pKR1757 | fatBF | 6.9 | 4.5 | 22.7 | 51.4 | 14.4 |
| MSE2888-13 | pKR1757 | fatBF | 7.5 | 4.2 | 21.9 | 55.2 | 11.2 |
| MSE2888-2 | pKR1757 | fatBF | 7.6 | 5.0 | 26.0 | 46.9 | 14.6 |
| MSE2888-21 | pKR1757 | fatBF | 7.8 | 4.3 | 23.8 | 52.0 | 12.0 |
| MSE2888-15 | pKR1757 | fatBF | 7.9 | 3.7 | 21.4 | 55.3 | 11.6 |
| MSE2888-31 | pKR1757 | fatBF | 8.1 | 5.5 | 30.3 | 44.3 | 11.7 |
| MSE2888-11 | pKR1757 | fatBF | 8.4 | 5.1 | 24.2 | 48.8 | 13.5 |
| MSE2888-20 | pKR1757 | fatBF | 8.7 | 5.2 | 23.2 | 48.0 | 14.9 |
| MSE2888-18 | pKR1757 | fatBF | 8.8 | 6.6 | 26.6 | 46.1 | 11.9 |
| MSE2888-14 | pKR1757 | fatBF | 8.8 | 4.2 | 20.9 | 53.9 | 12.3 |
| MSE2888-29 | pKR1757 | fatBF | 9.4 | 6.1 | 28.0 | 44.4 | 12.2 |
| MSE2888-16 | pKR1757 | fatBF | 9.4 | 4.8 | 23.0 | 49.7 | 13.0 |
| MSE2888-19 | pKR1757 | fatBF | 9.6 | 5.3 | 22.4 | 48.5 | 14.3 |
| MSE2888-23 | pKR1757 | fatBF | 9.7 | 5.0 | 22.7 | 47.9 | 14.8 |
| MSE2888-6 | pKR1757 | fatBF | 11.5 | 5.5 | 21.3 | 50.5 | 11.2 |
| MSE2888-17 | pKR1757 | fatBF | 12.3 | 4.4 | 20.6 | 49.4 | 13.3 |
| MSE2888-5 | pKR1757 | fatBF | 13.3 | 5.3 | 21.4 | 47.7 | 12.3 |
| MSE2888-10 | pKR1757 | fatBF | 13.5 | 5.5 | 22.6 | 45.9 | 12.4 |
| MSE2888-9 | pKR1757 | fatBF | 14.5 | 6.6 | 28.3 | 37.6 | 13.0 |
| MSE2888-3 | pKR1757 | fatBF | 15.0 | 8.0 | 25.4 | 39.2 | 12.5 |
| MSE2888-25 | pKR1757 | fatBF | 15.1 | 6.1 | 23.8 | 42.1 | 13.0 |
| MSE2888-8 | pKR1757 | fatBF | 15.1 | 6.7 | 26.1 | 40.9 | 11.2 |
| MSE2888-1 | pKR1757 | fatBF | 15.5 | 6.9 | 24.2 | 41.2 | 12.2 |
| MSE2888-7 | pKR1757 | fatBF | 16.0 | 5.3 | 20.2 | 46.6 | 11.9 |
| MSE2888-4 | pKR1757 | fatBF | 16.4 | 4.9 | 20.1 | 45.5 | 13.2 |
| MSE2888-24 | pKR1757 | fatBF | 16.5 | 5.1 | 19.3 | 46.4 | 12.7 |
| Avg. | | | 10.4 | 5.2 | 23.4 | 48.2 | 12.7 |
| MSE2889-7 | pKR1766 | fad3/fatBF | 6.9 | 3.8 | 22.9 | 60.6 | 5.9 |
| MSE2889-8 | pKR1766 | fad3/fatBF | 7.3 | 3.4 | 22.6 | 60.8 | 5.9 |
| MSE2889-16 | pKR1766 | fad3/fatBF | 9.5 | 4.3 | 21.9 | 57.6 | 6.7 |
| MSE2889-3 | pKR1766 | fad3/fatBF | 16.4 | 5.2 | 19.2 | 52.4 | 6.8 |
| MSE2889-15 | pKR1766 | fad3/fatBF | 12.5 | 5.5 | 23.0 | 51.8 | 7.1 |
| MSE2889-1 | pKR1766 | fad3/fatBF | 11.3 | 4.9 | 22.8 | 53.7 | 7.2 |
| MSE2889-2 | pKR1766 | fad3/fatBF | 8.7 | 5.6 | 27.5 | 51.0 | 7.2 |
| MSE2889-31 | pKR1766 | fad3/fatBF | 10.4 | 4.2 | 19.2 | 58.8 | 7.3 |
| MSE2889-18 | pKR1766 | fad3/fatBF | 9.9 | 4.1 | 19.3 | 59.4 | 7.4 |
| MSE2889-20 | pKR1766 | fad3/fatBF | 9.2 | 4.3 | 21.5 | 57.5 | 7.5 |
| MSE2889-14 | pKR1766 | fad3/fatBF | 11.5 | 5.3 | 23.5 | 51.8 | 7.9 |
| MSE2889-29 | pKR1766 | fad3/fatBF | 11.1 | 4.4 | 19.8 | 56.6 | 8.1 |
| MSE2889-9 | pKR1766 | fad3/fatBF | 9.5 | 4.1 | 21.6 | 56.6 | 8.2 |
| MSE2889-12 | pKR1766 | fad3/fatBF | 10.7 | 4.1 | 20.1 | 56.8 | 8.2 |
| MSE2889-11 | pKR1766 | fad3/fatBF | 11.3 | 4.7 | 20.4 | 54.0 | 9.5 |
| MSE2889-10 | pKR1766 | fad3/fatBF | 11.5 | 4.9 | 24.3 | 49.7 | 9.6 |
| MSE2889-19 | pKR1766 | fad3/fatBF | 11.8 | 5.2 | 23.3 | 49.5 | 10.2 |
| MSE2889-23 | pKR1766 | fad3/fatBF | 13.7 | 6.4 | 23.3 | 46.4 | 10.2 |
| MSE2889-13 | pKR1766 | fad3/fatBF | 12.7 | 4.2 | 20.4 | 52.3 | 10.3 |
| MSE2889-22 | pKR1766 | fad3/fatBF | 13.9 | 6.0 | 22.2 | 47.5 | 10.4 |
| MSE2889-28 | pKR1766 | fad3/fatBF | 12.0 | 4.9 | 22.7 | 50.0 | 10.4 |
| MSE2889-30 | pKR1766 | fad3/fatBF | 16.0 | 4.6 | 18.9 | 49.7 | 10.7 |
| MSE2889-4 | pKR1766 | fad3/fatBF | 12.4 | 5.9 | 23.6 | 46.9 | 11.1 |
| MSE2889-26 | pKR1766 | fad3/fatBF | 16.3 | 5.0 | 19.5 | 47.7 | 11.5 |
| MSE2889-6 | pKR1766 | fad3/fatBF | 14.9 | 5.8 | 20.9 | 46.7 | 11.7 |
| MSE2889-5 | pKR1766 | fad3/fatBF | 15.8 | 5.6 | 21.0 | 45.9 | 11.7 |
| MSE2889-21 | pKR1766 | fad3/fatBF | 15.4 | 4.2 | 19.9 | 48.5 | 12.0 |

TABLE 5-continued

Fatty Acid Profiles For MSE2887, MSE2888, MSE2889, MSE2890 and MSE2723

| Event | Construct | amiRNAs | 16:0 | 18:0 | 18:1 | 18:2 | 18:3 |
|---|---|---|---|---|---|---|---|
| MSE2889-17 | pKR1766 | fad3/fatBF | 15.7 | 6.7 | 21.9 | 43.6 | 12.0 |
| MSE2889-25 | pKR1766 | fad3/fatBF | 16.4 | 5.2 | 19.8 | 46.3 | 12.2 |
| MSE2889-24 | pKR1766 | fad3/fatBF | 15.6 | 6.0 | 22.3 | 43.5 | 12.6 |
| MSE2889-27 | pKR1766 | fad3/fatBF | 15.9 | 5.5 | 20.0 | 44.0 | 14.7 |
| Avg. | | | 12.5 | 5.0 | 21.6 | 51.5 | 9.4 |
| MSE2890-14 | pKR1771 | fatBF/fad3 | 5.0 | 3.2 | 21.9 | 55.6 | 14.3 |
| MSE2890-29 | pKR1771 | fatBF/fad3 | 6.7 | 5.3 | 25.7 | 55.5 | 6.8 |
| MSE2890-17 | pKR1771 | fatBF/fad3 | 7.3 | 5.2 | 27.9 | 46.3 | 13.3 |
| MSE2890-13 | pKR1771 | fatBF/fad3 | 7.6 | 5.0 | 24.8 | 50.1 | 12.6 |
| MSE2890-6 | pKR1771 | fatBF/fad3 | 7.8 | 3.8 | 20.9 | 58.8 | 8.7 |
| MSE2890-5 | pKR1771 | fatBF/fad3 | 8.3 | 3.7 | 22.7 | 54.7 | 10.7 |
| MSE2890-10 | pKR1771 | fatBF/fad3 | 9.0 | 4.5 | 22.0 | 54.5 | 9.9 |
| MSE2890-12 | pKR1771 | fatBF/fad3 | 9.3 | 5.3 | 23.0 | 52.7 | 9.7 |
| MSE2890-26 | pKR1771 | fatBF/fad3 | 9.3 | 4.8 | 22.8 | 53.5 | 9.5 |
| MSE2890-19 | pKR1771 | fatBF/fad3 | 10.2 | 5.5 | 23.2 | 51.8 | 9.4 |
| MSE2890-1 | pKR1771 | fatBF/fad3 | 10.8 | 5.2 | 21.3 | 51.1 | 11.6 |
| MSE2890-9 | pKR1771 | fatBF/fad3 | 10.8 | 5.4 | 22.7 | 47.6 | 13.4 |
| MSE2890-23 | pKR1771 | fatBF/fad3 | 11.0 | 4.2 | 19.3 | 55.1 | 10.5 |
| MSE2890-24 | pKR1771 | fatBF/fad3 | 11.4 | 5.9 | 23.4 | 50.4 | 8.8 |
| MSE2890-30 | pKR1771 | fatBF/fad3 | 11.6 | 3.8 | 20.2 | 53.3 | 11.2 |
| MSE2890-16 | pKR1771 | fatBF/fad3 | 11.6 | 4.2 | 18.4 | 53.4 | 12.4 |
| MSE2890-15 | pKR1771 | fatBF/fad3 | 12.9 | 4.9 | 19.7 | 49.3 | 13.2 |
| MSE2890-2 | pKR1771 | fatBF/fad3 | 13.0 | 5.6 | 24.6 | 47.2 | 9.6 |
| MSE2890-21 | pKR1771 | fatBF/fad3 | 13.8 | 6.3 | 23.1 | 45.6 | 11.1 |
| MSE2890-18 | pKR1771 | fatBF/fad3 | 14.1 | 4.3 | 20.4 | 50.3 | 10.9 |
| MSE2890-3 | pKR1771 | fatBF/fad3 | 15.2 | 5.6 | 20.9 | 45.3 | 13.0 |
| MSE2890-25 | pKR1771 | fatBF/fad3 | 15.6 | 5.2 | 21.0 | 44.8 | 13.4 |
| MSE2890-4 | pKR1771 | fatBF/fad3 | 15.6 | 5.7 | 20.9 | 46.1 | 11.6 |
| MSE2890-8 | pKR1771 | fatBF/fad3 | 15.8 | 5.5 | 19.2 | 42.8 | 16.6 |
| MSE2890-7 | pKR1771 | fatBF/fad3 | 15.9 | 4.7 | 19.1 | 45.8 | 14.5 |
| MSE2890-11 | pKR1771 | fatBF/fad3 | 16.0 | 6.0 | 18.8 | 42.5 | 16.7 |
| MSE2890-22 | pKR1771 | fatBF/fad3 | 16.0 | 4.2 | 18.6 | 47.3 | 13.9 |
| MSE2890-20 | pKR1771 | fatBF/fad3 | 16.2 | 5.2 | 19.7 | 47.3 | 11.7 |
| MSE2890-27 | pKR1771 | fatBF/fad3 | 16.5 | 6.5 | 21.0 | 43.4 | 12.6 |
| MSE2890-28 | pKR1771 | fatBF/fad3 | 16.7 | 4.4 | 18.1 | 48.1 | 12.6 |
| Avg. | | | 12.0 | 5.0 | 21.5 | 49.7 | 11.8 |
| MSE2723-14 | pKR1776 | fad2/fatB/fad3 | 6.2 | 2.5 | 36.3 | 39.9 | 15.1 |
| MSE2723-16 | pKR1776 | fad2/fatB/fad3 | 6.9 | 2.7 | 44.4 | 37.1 | 8.9 |
| MSE2723-25 | pKR1776 | fad2/fatB/fad3 | 7.5 | 3.9 | 49.2 | 29.6 | 9.7 |
| MSE2723-18 | pKR1776 | fad2/fatB/fad3 | 8.2 | 2.6 | 36.4 | 36.6 | 16.2 |
| MSE2723-4 | pKR1776 | fad2/fatB/fad3 | 8.5 | 3.5 | 24.9 | 52.4 | 10.7 |
| MSE2723-2 | pKR1776 | fad2/fatB/fad3 | 8.7 | 2.9 | 32.1 | 44.1 | 12.2 |
| MSE2723-13 | pKR1776 | fad2/fatB/fad3 | 9.0 | 5.1 | 50.6 | 25.0 | 10.3 |
| MSE2723-15 | pKR1776 | fad2/fatB/fad3 | 9.1 | 4.4 | 38.9 | 37.7 | 10.0 |
| MSE2723-7 | pKR1776 | fad2/fatB/fad3 | 11.0 | 4.4 | 25.5 | 42.8 | 16.3 |
| MSE2723-12 | pKR1776 | fad2/fatB/fad3 | 11.2 | 5.1 | 37.2 | 33.5 | 13.1 |
| MSE2723-3 | pKR1776 | fad2/fatB/fad3 | 11.2 | 4.6 | 45.7 | 28.7 | 9.7 |
| MSE2723-26 | pKR1776 | fad2/fatB/fad3 | 11.9 | 4.5 | 35.2 | 34.4 | 14.0 |
| MSE2723-17 | pKR1776 | fad2/fatB/fad3 | 11.9 | 3.9 | 25.5 | 40.4 | 18.2 |
| MSE2723-27 | pKR1776 | fad2/fatB/fad3 | 12.4 | 4.5 | 26.7 | 36.2 | 20.1 |
| MSE2723-22 | pKR1776 | fad2/fatB/fad3 | 13.4 | 5.0 | 19.9 | 48.4 | 13.2 |
| MSE2723-21 | pKR1776 | fad2/fatB/fad3 | 13.6 | 3.4 | 21.5 | 40.4 | 21.1 |
| MSE2723-31 | pKR1776 | fad2/fatB/fad3 | 13.7 | 4.9 | 17.4 | 51.5 | 12.5 |
| MSE2723-6 | pKR1776 | fad2/fatB/fad3 | 14.1 | 4.6 | 29.0 | 35.7 | 16.6 |
| MSE2723-1 | pKR1776 | fad2/fatB/fad3 | 14.5 | 4.1 | 25.5 | 39.2 | 16.7 |
| MSE2723-10 | pKR1776 | fad2/fatB/fad3 | 14.7 | 5.7 | 30.1 | 34.7 | 14.9 |
| MSE2723-30 | pKR1776 | fad2/fatB/fad3 | 14.9 | 5.2 | 13.8 | 40.4 | 25.7 |
| MSE2723-23 | pKR1776 | fad2/fatB/fad3 | 15.0 | 4.3 | 24.3 | 43.8 | 12.6 |
| MSE2723-8 | pKR1776 | fad2/fatB/fad3 | 15.7 | 4.5 | 12.8 | 38.8 | 28.1 |
| MSE2723-28 | pKR1776 | fad2/fatB/fad3 | 15.9 | 3.7 | 17.0 | 49.7 | 13.7 |
| MSE2723-29 | pKR1776 | fad2/fatB/fad3 | 16.3 | 5.2 | 17.2 | 44.0 | 17.3 |
| MSE2723-24 | pKR1776 | fad2/fatB/fad3 | 16.3 | 4.8 | 17.9 | 41.8 | 19.2 |
| MSE2723-9 | pKR1776 | fad2/fatB/fad3 | 16.4 | 3.8 | 12.8 | 44.0 | 23.1 |
| MSE2723-20 | pKR1776 | fad2/fatB/fad3 | 16.7 | 6.3 | 22.1 | 36.9 | 18.0 |
| MSE2723-5 | pKR1776 | fad2/fatB/fad3 | 16.8 | 4.2 | 15.5 | 48.1 | 15.5 |
| MSE2723-11 | pKR1776 | fad2/fatB/fad3 | 17.1 | 5.0 | 18.0 | 44.1 | 15.8 |
| MSE2723-19 | pKR1776 | fad2/fatB/fad3 | 17.5 | 4.1 | 19.3 | 45.3 | 13.7 |
| Avg. | | | 12.8 | 4.3 | 27.2 | 40.2 | 15.6 |

A summary of the average fatty acid profiles for each experiment is shown in Table 6. Also included in Table 6 is the range of fatty acid content for 16:0, 18:1 and 18:3 for each experiment.

TABLE 6

Average Fatty Acid Profiles For MSE2887,
MSE2888, MSE2889, MSE2890 and MSE2723

| Experiment | Avg. 16:0 | Avg. 18:0 | Avg. 18:1 | Avg. 18:2 | Avg. 18:3 | Range 16:0 | Range 18:1 | Range 18:3 |
|---|---|---|---|---|---|---|---|---|
| MSE2887 | 17.0 | 5.6 | 18.7 | 47.4 | 11.2 | 14.2-18.4 | 12.1-23.8 | 5.1-18.1 |
| MSE2888 | 10.4 | 5.2 | 23.4 | 48.2 | 12.7 | 4.7-16.5 | 19.3-30.3 | 11.2-12.7 |
| MSE2889 | 12.5 | 5.0 | 21.6 | 51.5 | 9.4 | 6.9-16.4 | 18.9-27.5 | 5.9-14.7 |
| MSE2890 | 12.0 | 5.0 | 21.5 | 49.7 | 11.8 | 5.0-16.7 | 18.1-27.9 | 6.8-16.7 |
| MSE2723 | 12.8 | 4.3 | 27.2 | 40.2 | 15.6 | 6.2-17.5 | 12.8-50.6 | 8.9-28.1 |

Table 6 shows that in all experiments where the fad3 amiRNA is present, the 18:3 content is significantly lowered while in MSE2888, 18:3 content resembles that for wild-type embryos. Similarly, in all experiments where the fatB amiRNA is present, 16:0 content is significantly lowered while in MSE2887, 16:0 content resembles that of wild-type embryos. When the fad2 amiRNA is added oleic acid contents increase significantly above what is seen when the fatB amiRNA, fad3 amiRNA or both fatB and fad3 amiRNAs are present.

Example 5

Expression of amiRNAs for Silencing Soy Fatty Acid Biosynthetic Genes in Soybean Seed Plasmid DNA fragments from PHP32511, containing the 159-fad2-1b amiRNA (SEQ ID NO: 32), PHP32510, containing the 396b-fad2-1b amiRNA (SEQ ID NO: 33), PHP32843, containing the 369b-fad2-1b & 159-fad2-2 amiRNAs (SEQ ID NO: 34), PHP33705, containing the 396-fad2-1b & 396b-sad3 amiRNA (SEQ ID NO: 35), PHP38557, containing the 159-fad3c amiRNA (SEQ ID NO: 36) and PHP41103, containing the 159-fatBF amiRNA (SEQ ID NO: 37) were transformed into soybean embryogenic suspension cultures (cv. Jack) as described in Example 4.

Plasmid DNA fragment from PHP41784 (SEQ ID NO: 42), containing the 159-fad2-1b & 159-fatBF& 159-fad3c amiRNAs, was transformed into soybean embryogenic suspension culture (cv. 93B86) also as described in Example 4.

DNA was prepared, transgenic embryos were matured and transgenic plants were obtained as described below.

Preparation of DNA for Bombardment:

For every seventeen bombardment transformations, 85 µL of suspension is prepared containing 1 to 90 picograms (pg) of purified fragment from plasmid DNA per base pair of each DNA fragment. DNA fragments were co-precipitated onto gold particles as follows. The DNAs in suspension were added to 50 µL of a 20-60 mg/mL 0.6 µm gold particle suspension and then combined with 50 µL CaCl$_2$ (2.5 M) and 20 µL spermidine (0.1 M). The mixture was vortexed for 5 sec, spun in a microfuge for 5 sec, and the supernatant removed. The DNA-coated particles were then washed once with 150 µL of 100% ethanol, vortexed and spun in a microfuge again, then resuspended in 85 µL of anhydrous ethanol. Five µL of the DNA-coated gold particles were then loaded on each macrocarrier disk.

Embryo Maturation:

Seven days after bombardment, the liquid medium was exchanged with fresh SB196 medium supplemented with 30-50 mg/L hygromycin. The selective medium was subsequently refreshed weekly or biweekly. Seven weeks post-bombardment, bright green, transformed tissue was observed growing from untransformed, chlorotic or necrotic embryogenic clusters. Isolated green tissue was removed and inoculated into individual wells in six-well culture dishes to generate new, clonally-propagated, transformed embryogenic suspension cultures. Thus, each new line was treated as independent transformation event in an individual well. These suspensions can then be maintained as suspensions of embryos clustered in an immature developmental stage through subculture or they can be regenerated into whole plants by maturation and germination of individual somatic embryos.

After two weeks in individual cell wells, transformed embryogenic clusters were removed from liquid culture and placed on solidified medium (SB166) containing no hormones or antibiotics for one week. Embryos were cultured for at 26° C. with mixed fluorescent and incandescent lights on a 16 h day/8 h night schedule. After one week, the cultures were then transferred to SB103 medium and maintained in the same growth conditions for 3 additional weeks.

Plant Regeneration:

Somatic embryos became suitable for germination after four weeks. As described in Example 4, somatic embryos are a good model zygotic embryos and for each experiment, a subset of somatic embryos at this stage from each experiment were removed and analyzed for changes in fatty acid profile as described in Example 4.

In order to regenerate plants, remaining somatic embryos were then removed from the maturation medium and dried in empty petri dishes for one to five days. The dried embryos were then planted in SB71-4 medium where they were allowed to germinate under the same light and temperature conditions as described above. Germinated embryos were transferred to sterile soil and grown to maturity for seed production.

T1 seed were screened for alterations in fatty acid composition. For every event, approximately 10-20 T1 seed were analyzed. Soybean seed chips were produced by cutting the seed with a razorblade avoiding the embryonic axis. Seed chips of approximately 2 mg were placed in a vial containing 50 µL TMSH and 0.5 mL hexane and after incubation at room temperature for 30 min., fatty acid methyl esters (FAMES) from the hexane phase were analyzed by GC as described in Example 4. Subsequent generations of greenhouse or field grown seed was analyzed similarly for changes in fatty acid composition.

The fatty acid profile for T1 seed analyzed from soy transformed with PHP32510, containing the 369b-fad2-1b amiRNA is shown in Table 7a.

The fatty acid profile for T1 seed analyzed from soy transformed with PHP32511, containing the 159-fad2-1b amiRNA is shown in Table 7b.

The fatty acid profile for T1 seed analyzed from soy transformed with PHP32843, containing the 369b-fad2-1b & 159-fad2-2 amiRNAs is shown in Table 7c.

The fatty acid profile for T1 seed analyzed from soy transformed with PHP33705, containing the 396-fad2-1b & 396b-sad3 amiRNAs is shown in Table 17d.

The fatty acid profile for T1 seed analyzed from soy transformed with PHP38557, containing the 159-fad3c amiRNA, is shown in Table 7e.

The fatty acid profile for T1 seed analyzed from soy transformed with PHP41103, containing the 159-fatBF amiRNA, is shown in Table 7f.

The fatty acid profile for T1 seed analyzed from soy transformed with PHP41784, containing the 159-fad2-1b & 159-fatBF& 159-fad3c amiRNAs is shown in Table 7g.

TABLE 7a

Fatty acid profile for T1 seed analyzed from soy transformed with PHP32510, containing the 369b-fad2-1b amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396b-fad2-1b | PHP32510 | AFS 5260.2.3 | 1 |  | 7.9 | 3.2 | 77.5 | 3.4 | 7.9 |
| 396b-fad2-1b | PHP32510 | AFS 5260.2.3 | 2 | 8GR31-2 | 7.6 | 3.2 | 80.2 | 2.3 | 6.7 |
| 396b-fad2-1b | PHP32510 | AFS 5260.2.3 | 3 |  | 11.5 | 3.9 | 15.4 | 55.7 | 13.4 |
| 396b-fad2-1b | PHP32510 | AFS 5260.2.3 | 4 |  | 11.3 | 3.9 | 11.4 | 56.4 | 17.0 |
| 396b-fad2-1b | PHP32510 | AFS 5260.2.3 | 5 |  | 9.4 | 3.1 | 72.7 | 5.3 | 9.5 |
| 396b-fad2-1b | PHP32510 | AFS 5260.2.3 | 6 |  | 8.3 | 3.1 | 77.6 | 2.9 | 8.2 |
| 396b-fad2-1b | PHP32510 | AFS 5260.2.4 | 1 |  | 12.1 | 3.7 | 14.5 | 55.6 | 14.1 |
| 396b-fad2-1b | PHP32510 | AFS 5260.2.4 | 2 |  | 13.1 | 2.7 | 12.5 | 54.8 | 16.9 |
| 396b-fad2-1b | PHP32510 | AFS 5260.2.4 | 3 |  | 11.8 | 3.5 | 15.8 | 57.1 | 11.7 |
| 396b-fad2-1b | PHP32510 | AFS 5260.2.4 | 4 |  | 11.7 | 3.5 | 17.4 | 56.1 | 11.3 |
| 396b-fad2-1b | PHP32510 | AFS 5260.2.4 | 5 |  | 8.5 | 3.6 | 74.6 | 4.5 | 8.8 |
| 396b-fad2-1b | PHP32510 | AFS 5260.2.4 | 6 |  | 9.1 | 3.9 | 72.0 | 5.9 | 9.1 |
| 396b-fad2-1b | PHP32510 | AFS 5260.3.10 | 1 |  | 13.1 | 3.4 | 22.6 | 46.7 | 14.3 |
| 396b-fad2-1b | PHP32510 | AFS 5260.3.10 | 2 |  | 11.7 | 3.4 | 18.0 | 52.2 | 14.7 |
| 396b-fad2-1b | PHP32510 | AFS 5260.3.10 | 3 |  | 11.2 | 3.1 | 22.2 | 49.9 | 13.6 |
| 396b-fad2-1b | PHP32510 | AFS 5260.3.10 | 4 |  | 12.6 | 3.0 | 20.3 | 47.4 | 16.6 |
| 396b-fad2-1b | PHP32510 | AFS 5260.3.10 | 5 |  | 12.4 | 3.4 | 17.5 | 52.6 | 14.1 |
| 396b-fad2-1b | PHP32510 | AFS 5260.3.10 | 6 |  | 14.2 | 3.1 | 12.6 | 50.5 | 19.6 |
| 396b-fad2-1b | PHP32510 | AFS 5260.3.11 | 1 | 8GR31-7 | 8.3 | 2.9 | 79.8 | 1.9 | 7.0 |
| 396b-fad2-1b | PHP32510 | AFS 5260.3.11 | 2 |  | 7.6 | 2.5 | 80.5 | 1.6 | 7.9 |
| 396b-fad2-1b | PHP32510 | AFS 5260.3.11 | 3 |  | 7.9 | 2.8 | 79.9 | 2.2 | 7.2 |
| 396b-fad2-1b | PHP32510 | AFS 5260.3.11 | 4 |  | 8.6 | 3.2 | 76.1 | 3.8 | 8.3 |
| 396b-fad2-1b | PHP32510 | AFS 5260.3.11 | 5 |  | 8.0 | 2.2 | 81.8 | 2.2 | 5.8 |
| 396b-fad2-1b | PHP32510 | AFS 5260.3.11 | 6 |  | 8.5 | 2.3 | 77.0 | 2.3 | 9.9 |
| 396b-fad2-1b | PHP32510 | AFS 5260.3.3 | 1 |  | 10.8 | 3.3 | 18.8 | 56.5 | 10.7 |
| 396b-fad2-1b | PHP32510 | AFS 5260.3.3 | 2 |  | 12.4 | 3.2 | 20.2 | 53.7 | 10.6 |
| 396b-fad2-1b | PHP32510 | AFS 5260.3.3 | 3 |  | 9.3 | 2.9 | 78.6 | 3.5 | 5.7 |
| 396b-fad2-1b | PHP32510 | AFS 5260.3.3 | 4 |  | 8.1 | 3.3 | 76.4 | 4.2 | 8.1 |
| 396b-fad2-1b | PHP32510 | AFS 5260.3.3 | 5 |  | 9.0 | 3.0 | 76.3 | 3.8 | 7.8 |
| 396b-fad2-1b | PHP32510 | AFS 5260.3.3 | 6 | 8GR31-16 | 9.3 | 3.3 | 74.4 | 5.7 | 7.3 |
| 396b-fad2-1b | PHP32510 | AFS 5260.3.6 | 1 | 8GR31-19 | 12.1 | 3.5 | 18.5 | 54.0 | 11.9 |
| 396b-fad2-1b | PHP32510 | AFS 5260.3.6 | 2 |  | 7.6 | 3.5 | 82.8 | 1.3 | 4.8 |
| 396b-fad2-1b | PHP32510 | AFS 5260.3.6 | 3 |  | 12.1 | 4.0 | 19.5 | 53.4 | 11.0 |
| 396b-fad2-1b | PHP32510 | AFS 5260.3.6 | 4 |  | 8.4 | 4.2 | 75.3 | 3.9 | 8.1 |
| 396b-fad2-1b | PHP32510 | AFS 5260.3.6 | 5 |  | 8.1 | 3.3 | 79.5 | 2.3 | 6.9 |
| 396b-fad2-1b | PHP32510 | AFS 5260.3.6 | 6 |  | 8.4 | 3.5 | 77.8 | 3.2 | 7.1 |
| 396b-fad2-1b | PHP32510 | AFS 5260.4.11 | 1 |  | 11.1 | 3.6 | 10.0 | 54.5 | 20.9 |
| 396b-fad2-1b | PHP32510 | AFS 5260.4.11 | 2 |  | 8.2 | 3.1 | 73.1 | 6.2 | 9.5 |
| 396b-fad2-1b | PHP32510 | AFS 5260.4.11 | 3 |  | 11.9 | 3.2 | 12.7 | 55.4 | 16.7 |
| 396b-fad2-1b | PHP32510 | AFS 5260.4.11 | 4 |  | 8.6 | 3.0 | 70.8 | 7.8 | 9.8 |
| 396b-fad2-1b | PHP32510 | AFS 5260.4.11 | 5 |  | 11.2 | 3.3 | 13.0 | 56.2 | 16.3 |
| 396b-fad2-1b | PHP32510 | AFS 5260.4.11 | 6 |  | 11.8 | 3.5 | 12.0 | 53.7 | 19.0 |
| 396b-fad2-1b | PHP32510 | AFS 5260.4.5 | 1 |  | 11.2 | 3.4 | 12.4 | 57.1 | 15.9 |
| 396b-fad2-1b | PHP32510 | AFS 5260.4.5 | 2 |  | 8.1 | 3.2 | 75.8 | 4.4 | 8.5 |
| 396b-fad2-1b | PHP32510 | AFS 5260.4.5 | 3 | 8GR31-24 | 8.4 | 3.1 | 75.8 | 4.8 | 7.9 |
| 396b-fad2-1b | PHP32510 | AFS 5260.4.5 | 4 |  | 11.4 | 3.2 | 15.1 | 54.2 | 16.2 |
| 396b-fad2-1b | PHP32510 | AFS 5260.4.5 | 5 |  | 7.8 | 3.4 | 78.7 | 2.9 | 7.2 |
| 396b-fad2-1b | PHP32510 | AFS 5260.4.5 | 6 |  | 8.2 | 3.4 | 72.2 | 7.0 | 9.2 |
| 396b-fad2-1b | PHP32510 | AFS 5260.4.8 | 1 |  | 8.0 | 3.2 | 78.4 | 3.2 | 7.2 |
| 396b-fad2-1b | PHP32510 | AFS 5260.4.8 | 2 |  | 10.9 | 3.6 | 11.8 | 58.0 | 15.7 |
| 396b-fad2-1b | PHP32510 | AFS 5260.4.8 | 3 |  | 7.7 | 3.4 | 77.2 | 3.6 | 8.1 |
| 396b-fad2-1b | PHP32510 | AFS 5260.4.8 | 4 |  | 7.9 | 3.1 | 76.1 | 4.2 | 8.7 |
| 396b-fad2-1b | PHP32510 | AFS 5260.4.8 | 5 |  | 8.6 | 2.9 | 73.7 | 5.9 | 9.0 |
| 396b-fad2-1b | PHP32510 | AFS 5260.4.8 | 6 |  | 8.3 | 2.9 | 77.6 | 3.5 | 7.7 |
| 396b-fad2-1b | PHP32510 | AFS 5260.4.9 | 1 |  | 12.6 | 2.5 | 17.2 | 51.3 | 16.4 |
| 396b-fad2-1b | PHP32510 | AFS 5260.4.9 | 2 |  | 11.9 | 3.1 | 12.7 | 54.3 | 17.9 |
| 396b-fad2-1b | PHP32510 | AFS 5260.4.9 | 3 |  | 11.5 | 3.6 | 13.0 | 56.3 | 15.6 |
| 396b-fad2-1b | PHP32510 | AFS 5260.4.9 | 4 |  | 12.2 | 2.9 | 13.5 | 52.5 | 18.9 |

TABLE 7a-continued

Fatty acid profile for T1 seed analyzed from soy transformed with PHP32510, containing the 369b-fad2-1b amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396b-fad2-1b | PHP32510 | AFS 5260.4.9 | 5 | | 11.5 | 2.7 | 9.9 | 54.0 | 21.9 |
| 396b-fad2-1b | PHP32510 | AFS 5260.4.9 | 6 | | 9.7 | 2.6 | 17.0 | 58.8 | 12.0 |
| 396b-fad2-1b | PHP32510 | AFS 5260.3.1 | 1 | | 13.0 | 3.6 | 14.1 | 57.1 | 12.2 |
| 396b-fad2-1b | PHP32510 | AFS 5260.3.1 | 2 | | 7.9 | 3.9 | 79.5 | 2.7 | 6.0 |
| 396b-fad2-1b | PHP32510 | AFS 5260.3.1 | 3 | | 8.5 | 4.1 | 76.1 | 4.3 | 7.1 |
| 396b-fad2-1b | PHP32510 | AFS 5260.3.1 | 4 | | 8.5 | 3.8 | 78.1 | 2.9 | 6.7 |
| 396b-fad2-1b | PHP32510 | AFS 5260.3.1 | 5 | | 12.0 | 4.3 | 14.3 | 56.1 | 13.3 |
| 396b-fad2-1b | PHP32510 | AFS 5260.3.1 | 6 | | 9.0 | 3.8 | 75.9 | 4.0 | 7.3 |

TABLE 7b

Fatty acid profile for T1 seed analyzed from soy transformed with PHP32511, containing the 159-fad2-1b amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b | PHP32511 | AFS 5292.5.8 | 1 | | 9.8 | 3.3 | 70.1 | 7.0 | 9.9 |
| 159-fad2-1b | PHP32511 | AFS 5292.5.8 | 2 | | 9.1 | 3.3 | 74.5 | 4.3 | 8.8 |
| 159-fad2-1b | PHP32511 | AFS 5292.5.8 | 3 | 8GR31-38 | 9.9 | 3.2 | 72.9 | 4.8 | 9.2 |
| 159-fad2-1b | PHP32511 | AFS 5292.5.8 | 4 | | 12.3 | 3.5 | 17.8 | 54.0 | 12.3 |
| 159-fad2-1b | PHP32511 | AFS 5292.5.8 | 5 | | 13.1 | 3.7 | 13.5 | 56.4 | 13.4 |
| 159-fad2-1b | PHP32511 | AFS 5292.5.8 | 6 | | 8.6 | 3.5 | 74.4 | 4.7 | 8.8 |
| 159-fad2-1b | PHP32511 | AFS 5292.6.8 | 1 | | 14.1 | 3.5 | 11.1 | 56.3 | 15.0 |
| 159-fad2-1b | PHP32511 | AFS 5292.6.8 | 2 | | 10.6 | 3.3 | 69.6 | 6.7 | 9.9 |
| 159-fad2-1b | PHP32511 | AFS 5292.6.8 | 3 | | 12.8 | 3.2 | 12.7 | 58.5 | 12.8 |
| 159-fad2-1b | PHP32511 | AFS 5292.6.8 | 4 | | 12.5 | 3.5 | 14.9 | 58.1 | 11.1 |
| 159-fad2-1b | PHP32511 | AFS 5292.6.8 | 5 | | 12.0 | 3.6 | 12.9 | 59.0 | 12.4 |
| 159-fad2-1b | PHP32511 | AFS 5292.6.8 | 6 | | 13.2 | 3.1 | 10.9 | 59.0 | 13.8 |
| 159-fad2-1b | PHP32511 | AFS 5292.7.6 | 1 | | 10.9 | 3.6 | 69.9 | 5.6 | 10.0 |
| 159-fad2-1b | PHP32511 | AFS 5292.7.6 | 2 | 8GR31-42 | 9.3 | 3.4 | 73.9 | 4.8 | 8.6 |
| 159-fad2-1b | PHP32511 | AFS 5292.7.6 | 3 | | 10.9 | 3.2 | 68.7 | 6.2 | 11.0 |
| 159-fad2-1b | PHP32511 | AFS 5292.7.6 | 4 | 8GR31-44 | 9.5 | 3.4 | 67.1 | 8.9 | 11.0 |
| 159-fad2-1b | PHP32511 | AFS 5292.7.6 | 5 | | 11.0 | 2.8 | 72.7 | 4.5 | 9.0 |
| 159-fad2-1b | PHP32511 | AFS 5292.7.6 | 6 | | 8.7 | 3.2 | 74.5 | 5.0 | 8.7 |
| 159-fad2-1b | PHP32511 | AFS 5292.8.3 | 1 | | 8.8 | 3.9 | 74.1 | 4.4 | 8.8 |
| 159-fad2-1b | PHP32511 | AFS 5292.8.3 | 2 | | 12.0 | 3.9 | 13.5 | 58.6 | 12.1 |
| 159-fad2-1b | PHP32511 | AFS 5292.8.3 | 3 | | 8.2 | 4.3 | 75.2 | 4.5 | 7.8 |
| 159-fad2-1b | PHP32511 | AFS 5292.8.3 | 4 | | 9.6 | 3.4 | 65.4 | 10.6 | 11.0 |
| 159-fad2-1b | PHP32511 | AFS 5292.8.3 | 5 | | 8.3 | 3.4 | 73.1 | 6.2 | 9.0 |
| 159-fad2-1b | PHP32511 | AFS 5292.8.3 | 6 | | 8.3 | 3.0 | 73.8 | 6.3 | 8.5 |
| 159-fad2-1b | PHP32511 | AFS 5292.8.8 | 1 | | 11.6 | 3.3 | 19.6 | 52.7 | 12.7 |
| 159-fad2-1b | PHP32511 | AFS 5292.8.8 | 2 | | 9.1 | 3.4 | 74.5 | 4.7 | 8.3 |
| 159-fad2-1b | PHP32511 | AFS 5292.8.8 | 3 | | 8.7 | 3.3 | 80.2 | 1.4 | 6.5 |
| 159-fad2-1b | PHP32511 | AFS 5292.8.8 | 4 | | 9.2 | 2.9 | 42.2 | 39.9 | 5.8 |
| 159-fad2-1b | PHP32511 | AFS 5292.8.8 | 5 | | 8.8 | 3.5 | 77.8 | 3.2 | 6.8 |
| 159-fad2-1b | PHP32511 | AFS 5292.8.8 | 6 | | 8.8 | 3.2 | 77.5 | 2.6 | 7.8 |
| 159-fad2-1b | PHP32511 | AFS 5292.1.4 | 1 | | 8.2 | 3.5 | 76.4 | 4.1 | 7.8 |
| 159-fad2-1b | PHP32511 | AFS 5292.1.4 | 2 | | 8.0 | 3.2 | 77.1 | 3.7 | 8.0 |
| 159-fad2-1b | PHP32511 | AFS 5292.1.4 | 3 | 8GR31-58 | 8.2 | 3.4 | 78.1 | 2.7 | 7.6 |
| 159-fad2-1b | PHP32511 | AFS 5292.1.4 | 4 | 8GR31-59 | 8.2 | 3.2 | 78.6 | 2.6 | 7.3 |
| 159-fad2-1b | PHP32511 | AFS 5292.1.4 | 5 | | 8.1 | 3.6 | 76.2 | 4.6 | 7.6 |
| 159-fad2-1b | PHP32511 | AFS 5292.1.4 | 6 | 8GR31-61 | 8.3 | 4.2 | 77.9 | 2.8 | 6.7 |
| 159-fad2-1b | PHP32511 | AFS 5292.5.2 | 1 | | 10.1 | 3.9 | 76.2 | 2.6 | 7.3 |
| 159-fad2-1b | PHP32511 | AFS 5292.5.2 | 2 | | 7.8 | 3.4 | 82.7 | 1.4 | 4.8 |
| 159-fad2-1b | PHP32511 | AFS 5292.5.2 | 3 | | 8.4 | 3.3 | 81.5 | 1.3 | 5.6 |
| 159-fad2-1b | PHP32511 | AFS 5292.5.2 | 4 | | 7.6 | 3.6 | 82.3 | 1.4 | 5.1 |
| 159-fad2-1b | PHP32511 | AFS 5292.5.2 | 5 | | 12.8 | 3.7 | 13.0 | 56.4 | 14.2 |
| 159-fad2-1b | PHP32511 | AFS 5292.5.2 | 6 | | 8.4 | 3.2 | 82.0 | 1.5 | 5.0 |
| 159-fad2-1b | PHP32511 | AFS 5292.6.5 | 1 | | 13.2 | 3.3 | 19.5 | 54.8 | 9.2 |
| 159-fad2-1b | PHP32511 | AFS 5292.6.5 | 2 | | 12.2 | 3.2 | 18.6 | 54.6 | 11.3 |
| 159-fad2-1b | PHP32511 | AFS 5292.6.5 | 3 | 8GR31-67 | 8.0 | 3.0 | 79.5 | 2.6 | 6.8 |
| 159-fad2-1b | PHP32511 | AFS 5292.6.5 | 4 | | 8.4 | 2.9 | 80.9 | 1.9 | 5.7 |
| 159-fad2-1b | PHP32511 | AFS 5292.6.5 | 5 | | 8.8 | 4.1 | 75.5 | 4.2 | 7.5 |
| 159-fad2-1b | PHP32511 | AFS 5292.6.5 | 6 | | 12.8 | 3.5 | 20.6 | 53.1 | 10.0 |
| 159-fad2-1b | PHP32511 | AFS 5292.7.1 | 1 | | 11.3 | 3.1 | 63.9 | 10.0 | 11.7 |
| 159-fad2-1b | PHP32511 | AFS 5292.7.1 | 2 | | 7.3 | 3.5 | 82.8 | 1.4 | 5.0 |
| 159-fad2-1b | PHP32511 | AFS 5292.7.1 | 3 | | 12.5 | 2.9 | 32.6 | 44.8 | 7.2 |
| 159-fad2-1b | PHP32511 | AFS 5292.7.1 | 4 | | 7.6 | 3.6 | 81.0 | 2.2 | 5.6 |
| 159-fad2-1b | PHP32511 | AFS 5292.7.1 | 5 | | 11.6 | 3.4 | 15.6 | 58.7 | 10.7 |
| 159-fad2-1b | PHP32511 | AFS 5292.7.1 | 6 | | 11.3 | 3.4 | 18.9 | 56.4 | 10.1 |

TABLE 7b-continued

Fatty acid profile for T1 seed analyzed from soy transformed with PHP32511, containing the 159-fad2-1b amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b | PHP32511 | AFS 5292.7.2 | 1 | 8GR31-73 | 8.6 | 3.2 | 80.4 | 2.1 | 5.7 |
| 159-fad2-1b | PHP32511 | AFS 5292.7.2 | 2 | 8GR31-74 | 8.3 | 3.1 | 81.9 | 1.4 | 5.3 |
| 159-fad2-1b | PHP32511 | AFS 5292.7.2 | 3 | 8GR31-75 | 8.7 | 3.2 | 81.5 | 1.6 | 4.9 |
| 159-fad2-1b | PHP32511 | AFS 5292.7.2 | 4 | 8GR31-76 | 8.1 | 3.2 | 80.2 | 2.1 | 6.5 |
| 159-fad2-1b | PHP32511 | AFS 5292.7.2 | 5 |  | 9.0 | 3.3 | 77.5 | 2.7 | 7.5 |
| 159-fad2-1b | PHP32511 | AFS 5292.7.2 | 6 | 8GR31-78 | 8.0 | 3.3 | 81.3 | 1.9 | 5.6 |
| 159-fad2-1b | PHP32511 | AFS 5292.8.2 | 1 |  | 13.3 | 3.2 | 16.4 | 54.4 | 12.7 |
| 159-fad2-1b | PHP32511 | AFS 5292.8.2 | 2 |  | 12.9 | 3.0 | 17.5 | 54.9 | 11.8 |
| 159-fad2-1b | PHP32511 | AFS 5292.8.2 | 3 |  | 12.5 | 3.1 | 17.0 | 56.1 | 11.4 |
| 159-fad2-1b | PHP32511 | AFS 5292.8.2 | 4 |  | 12.7 | 3.0 | 17.6 | 55.1 | 11.7 |
| 159-fad2-1b | PHP32511 | AFS 5292.8.2 | 5 |  | 12.5 | 3.0 | 19.0 | 54.9 | 10.6 |
| 159-fad2-1b | PHP32511 | AFS 5292.8.2 | 6 |  | 13.0 | 3.1 | 17.2 | 54.1 | 12.6 |

TABLE 7c

Fatty acid profile for T1 seed analyzed from soy transformed with PHP32843, containing the 369b-fad2-1b & 159-fad2-2 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396b-fad2-1b/ 159-fad2-2 | PHP32843 | AFS 5396.1.11 | 1 |  | 8.2 | 3.0 | 85.8 | 0.4 | 2.7 |
| 396b-fad2-1b/ 159-fad2-2 | PHP32843 | AFS 5396.1.11 | 2 |  | 7.9 | 3.3 | 85.4 | 0.5 | 2.9 |
| 396b-fad2-1b/ 159-fad2-2 | PHP32843 | AFS 5396.1.11 | 3 |  | 8.2 | 3.2 | 85.8 | 0.4 | 2.6 |
| 396b-fad2-1b/ 159-fad2-2 | PHP32843 | AFS 5396.1.11 | 4 |  | 8.1 | 3.3 | 85.6 | 0.4 | 2.6 |
| 396b-fad2-1b/ 159-fad2-2 | PHP32843 | AFS 5396.1.11 | 5 |  | 8.3 | 3.1 | 85.2 | 0.4 | 2.9 |
| 396b-fad2-1b/ 159-fad2-2 | PHP32843 | AFS 5396.1.11 | 6 |  | 13.1 | 3.5 | 11.4 | 55.1 | 16.8 |
| 396b-fad2-1b/ 159-fad2-2 | PHP32843 | AFS 5396.1.2 | 1 |  | 11.5 | 3.3 | 20.0 | 55.0 | 10.2 |
| 396b-fad2-1b/ 159-fad2-2 | PHP32843 | AFS 5396.1.2 | 2 |  | 7.2 | 3.2 | 87.3 | 0.3 | 2.0 |
| 396b-fad2-1b/ 159-fad2-2 | PHP32843 | AFS 5396.1.2 | 3 |  | 7.6 | 2.9 | 86.7 | 0.4 | 2.4 |
| 396b-fad2-1b/ 159-fad2-2 | PHP32843 | AFS 5396.1.2 | 4 |  | 7.6 | 3.3 | 85.9 | 0.5 | 2.7 |
| 396b-fad2-1b/ 159-fad2-2 | PHP32843 | AFS 5396.1.2 | 5 |  | 7.9 | 3.0 | 86.7 | 0.3 | 2.1 |
| 396b-fad2-1b/ 159-fad2-2 | PHP32843 | AFS 5396.1.2 | 6 |  | 8.1 | 3.0 | 84.0 | 1.0 | 4.0 |
| 396b-fad2-1b/ 159-fad2-2 | PHP32843 | AFS 5396.1.4 | 1 |  | 7.8 | 3.3 | 83.4 | 1.3 | 4.2 |
| 396b-fad2-1b/ 159-fad2-2 | PHP32843 | AFS 5396.1.4 | 2 |  | 7.5 | 3.2 | 85.7 | 0.7 | 2.9 |
| 396b-fad2-1b/ 159-fad2-2 | PHP32843 | AFS 5396.1.4 | 3 |  | 7.7 | 3.1 | 83.7 | 1.2 | 4.3 |
| 396b-fad2-1b/ 159-fad2-2 | PHP32843 | AFS 5396.1.4 | 4 |  | 8.4 | 3.6 | 82.1 | 1.3 | 4.7 |
| 396b-fad2-1b/ 159-fad2-2 | PHP32843 | AFS 5396.1.4 | 5 |  | 7.2 | 3.2 | 86.0 | 0.7 | 2.9 |
| 396b-fad2-1b/ 159-fad2-2 | PHP32843 | AFS 5396.1.4 | 6 |  | 7.4 | 3.4 | 85.7 | 0.6 | 2.9 |
| 396b-fad2-1b/ 159-fad2-2 | PHP32843 | AFS 5396.1.5 | 1 |  | 8.3 | 2.9 | 80.5 | 2.9 | 5.4 |
| 396b-fad2-1b/ 159-fad2-2 | PHP32843 | AFS 5396.1.7 | 1 |  | 12.9 | 3.2 | 16.0 | 53.5 | 14.4 |
| 396b-fad2-1b/ 159-fad2-2 | PHP32843 | AFS 5396.1.7 | 2 |  | 7.5 | 3.1 | 85.2 | 1.0 | 3.3 |
| 396b-fad2-1b/ 159-fad2-2 | PHP32843 | AFS 5396.1.7 | 3 |  | 7.8 | 2.8 | 84.0 | 1.3 | 4.1 |
| 396b-fad2-1b/ 159-fad2-2 | PHP32843 | AFS 5396.1.7 | 4 |  | 7.1 | 3.3 | 87.3 | 0.4 | 1.9 |
| 396b-fad2-1b/ 159-fad2-2 | PHP32843 | AFS 5396.1.7 | 5 |  | 7.4 | 3.2 | 85.2 | 0.9 | 3.3 |
| 396b-fad2-1b/ 159-fad2-2 | PHP32843 | AFS 5396.1.7 | 6 |  | 11.8 | 3.4 | 18.0 | 54.2 | 12.6 |

TABLE 7c-continued

Fatty acid profile for T1 seed analyzed from soy transformed with PHP32843, containing the 369b-fad2-1b & 159-fad2-2 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396b-fad2-1b/ 159-fad2-2 | PHP32843 | AFS 5396.2.2 | 1 | | 8.1 | 2.9 | 83.8 | 1.2 | 4.0 |
| 396b-fad2-1b/ 159-fad2-2 | PHP32843 | AFS 5396.2.2 | 2 | 8GR31-140 | 7.8 | 2.5 | 86.6 | 0.6 | 2.5 |
| 396b-fad2-1b/ 159-fad2-2 | PHP32843 | AFS 5396.2.2 | 3 | | 13.5 | 2.8 | 14.3 | 56.7 | 12.7 |
| 396b-fad2-1b/ 159-fad2-2 | PHP32843 | AFS 5396.2.2 | 4 | | 8.0 | 2.8 | 85.0 | 1.1 | 3.1 |
| 396b-fad2-1b/ 159-fad2-2 | PHP32843 | AFS 5396.2.2 | 5 | | 8.3 | 2.4 | 84.6 | 1.3 | 3.4 |
| 396b-fad2-1b/ 159-fad2-2 | PHP32843 | AFS 5396.2.2 | 6 | | 7.7 | 2.4 | 87.2 | 0.7 | 2.0 |
| 396b-fad2-1b/ 159-fad2-2 | PHP32843 | AFS 5396.2.3 | 1 | | 13.2 | 3.3 | 16.6 | 56.3 | 10.7 |
| 396b-fad2-1b/ 159-fad2-2 | PHP32843 | AFS 5396.2.3 | 2 | | 7.4 | 2.7 | 85.8 | 1.1 | 3.0 |
| 396b-fad2-1b/ 159-fad2-2 | PHP32843 | AFS 5396.2.3 | 3 | 8GR31-145 | 7.3 | 2.6 | 87.5 | 0.7 | 2.0 |
| 396b-fad2-1b/ 159-fad2-2 | PHP32843 | AFS 5396.2.3 | 4 | | 13.2 | 3.0 | 13.0 | 60.9 | 10.0 |
| 396b-fad2-1b/ 159-fad2-2 | PHP32843 | AFS 5396.2.3 | 5 | | 7.5 | 2.5 | 86.6 | 0.9 | 2.5 |
| 396b-fad2-1b/ 159-fad2-2 | PHP32843 | AFS 5396.2.3 | 6 | | 12.7 | 3.0 | 20.3 | 55.1 | 8.9 |
| 396b-fad2-1b/ 159-fad2-2 | PHP32843 | AFS 5396.2.4 | 1 | | 7.8 | 3.0 | 86.1 | 0.5 | 2.6 |
| 396b-fad2-1b/ 159-fad2-2 | PHP32843 | AFS 5396.2.4 | 2 | | 7.6 | 3.0 | 86.7 | 0.4 | 2.3 |
| 396b-fad2-1b/ 159-fad2-2 | PHP32843 | AFS 5396.2.4 | 3 | | 7.4 | 3.3 | 86.1 | 0.6 | 2.6 |
| 396b-fad2-1b/ 159-fad2-2 | PHP32843 | AFS 5396.2.4 | 4 | | 7.5 | 3.4 | 86.3 | 0.6 | 2.2 |
| 396b-fad2-1b/ 159-fad2-2 | PHP32843 | AFS 5396.2.4 | 5 | | 12.6 | 3.9 | 17.4 | 54.0 | 12.1 |
| 396b-fad2-1b/ 159-fad2-2 | PHP32843 | AFS 5396.2.4 | 6 | | 7.6 | 3.1 | 86.4 | 0.7 | 2.2 |
| 396b-fad2-1b/ 159-fad2-2 | PHP32843 | AFS 5396.2.9 | 1 | | 7.5 | 3.1 | 86.7 | 0.6 | 2.0 |
| 396b-fad2-1b/ 159-fad2-2 | PHP32843 | AFS 5396.2.9 | 2 | | 13.0 | 3.5 | 17.9 | 53.3 | 12.3 |
| 396b-fad2-1b/ 159-fad2-2 | PHP32843 | AFS 5396.2.9 | 3 | | 7.5 | 3.1 | 85.8 | 0.8 | 2.8 |
| 396b-fad2-1b/ 159-fad2-2 | PHP32843 | AFS 5396.2.9 | 4 | | 13.1 | 3.4 | 17.6 | 53.9 | 12.0 |
| 396b-fad2-1b/ 159-fad2-2 | PHP32843 | AFS 5396.2.9 | 5 | | 7.5 | 3.2 | 85.4 | 0.9 | 2.9 |
| 396b-fad2-1b/ 159-fad2-2 | PHP32843 | AFS 5396.2.9 | 6 | | 7.5 | 3.2 | 86.6 | 0.6 | 2.1 |
| 396b-fad2-1b/ 159-fad2-2 | PHP32843 | AFS 5396.3.3 | 1 | | 13.9 | 3.0 | 10.9 | 58.0 | 14.2 |
| 396b-fad2-1b/ 159-fad2-2 | PHP32843 | AFS 5396.3.3 | 2 | | 13.3 | 2.9 | 8.2 | 60.9 | 14.7 |
| 396b-fad2-1b/ 159-fad2-2 | PHP32843 | AFS 5396.3.8 | 1 | 8GR31-156 | 7.2 | 3.0 | 87.0 | 0.4 | 2.3 |
| 396b-fad2-1b/ 159-fad2-2 | PHP32843 | AFS 5396.3.8 | 2 | 8GR31-157 | 7.9 | 2.9 | 84.8 | 0.8 | 3.6 |
| 396b-fad2-1b/ 159-fad2-2 | PHP32843 | AFS 5396.3.8 | 3 | | 7.6 | 2.7 | 86.0 | 0.7 | 2.9 |
| 396b-fad2-1b/ 159-fad2-2 | PHP32843 | AFS 5396.3.8 | 4 | | 12.1 | 3.4 | 12.6 | 57.9 | 14.0 |
| 396b-fad2-1b/ 159-fad2-2 | PHP32843 | AFS 5396.3.8 | 5 | | 11.6 | 3.1 | 17.4 | 55.1 | 12.7 |
| 396b-fad2-1b/ 159-fad2-2 | PHP32843 | AFS 5396.3.8 | 6 | | 11.5 | 3.3 | 19.3 | 54.2 | 11.8 |

TABLE 7d

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.1.1 | 1 | | 12.8 | 2.5 | 22.0 | 54.1 | 8.7 |
| 396-fad2-1b/396b-sad3 | PHP33705 | AFS 5489.1.1 | 2 | | 8.8 | 10.3 | 59.8 | 10.4 | 10.6 |
| 396-fad2-1b/396b-sad3 | PHP33705 | AFS 5489.1.1 | 3 | | 12.8 | 2.7 | 22.4 | 53.0 | 9.1 |
| 396-fad2-1b/396b-sad3 | PHP33705 | AFS 5489.1.1 | 4 | | 7.8 | 12.7 | 66.1 | 5.3 | 8.1 |
| 396-fad2-1b/396b-sad3 | PHP33705 | AFS 5489.1.1 | 5 | | 7.9 | 14.9 | 65.9 | 3.9 | 7.3 |
| 396-fad2-1b/396b-sad3 | PHP33705 | AFS 5489.1.1 | 6 | | 13.4 | 3.4 | 20.6 | 54.7 | 7.9 |
| 396-fad2-1b/396b-sad3 | PHP33705 | AFS 5489.1.2 | 1 | | 12.6 | 2.8 | 17.7 | 56.5 | 10.4 |
| 396-fad2-1b/396b-sad3 | PHP33705 | AFS 5489.1.2 | 2 | | 8.5 | 0.0 | 73.2 | 8.0 | 10.3 |
| 396-fad2-1b/396b-sad3 | PHP33705 | AFS 5489.1.2 | 3 | | 8.1 | 13.1 | 65.7 | 5.4 | 7.8 |
| 396-fad2-1b/396b-sad3 | PHP33705 | AFS 5489.1.2 | 4 | | 13.3 | 3.5 | 19.2 | 52.9 | 11.2 |
| 396-fad2-1b/396b-sad3 | PHP33705 | AFS 5489.1.2 | 5 | | 7.7 | 5.5 | 70.6 | 6.2 | 10.0 |
| 396-fad2-1b/396b-sad3 | PHP33705 | AFS 5489.1.2 | 6 | | 12.2 | 3.1 | 23.4 | 52.3 | 8.9 |
| 396-fad2-1b/396b-sad3 | PHP33705 | AFS 5489.2.2 | 1 | | 11.3 | 3.3 | 21.2 | 53.5 | 10.7 |
| 396-fad2-1b/396b-sad3 | PHP33705 | AFS 5489.2.2 | 2 | | 11.3 | 3.3 | 17.0 | 57.8 | 10.6 |
| 396-fad2-1b/396b-sad3 | PHP33705 | AFS 5489.2.2 | 3 | | 10.6 | 3.6 | 15.2 | 59.2 | 11.4 |
| 396-fad2-1b/396b-sad3 | PHP33705 | AFS 5489.2.2 | 4 | | 12.1 | 3.5 | 16.2 | 58.1 | 10.1 |
| 396-fad2-1b/396b-sad3 | PHP33705 | AFS 5489.2.2 | 5 | | 12.6 | 4.0 | 12.9 | 58.2 | 12.3 |
| 396-fad2-1b/396b-sad3 | PHP33705 | AFS 5489.2.2 | 6 | | 11.9 | 3.2 | 18.8 | 56.2 | 9.9 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.2.5 | 1 | | 12.4 | 3.2 | 15.5 | 57.1 | 11.8 |
| 396-fad2-1b/396b-sad3 | PHP33705 | AFS 5489.2.5 | 2 | | 11.9 | 3.4 | 15.8 | 56.9 | 12.0 |
| 396-fad2-1b/396b-sad3 | PHP33705 | AFS 5489.2.5 | 3 | | 11.9 | 3.0 | 17.8 | 56.7 | 10.7 |
| 396-fad2-1b/396b-sad3 | PHP33705 | AFS 5489.2.5 | 4 | | 12.9 | 3.2 | 11.5 | 57.2 | 15.1 |
| 396-fad2-1b/396b-sad3 | PHP33705 | AFS 5489.2.5 | 5 | | 7.6 | 9.4 | 69.8 | 5.1 | 8.1 |
| 396-fad2-1b/396b-sad3 | PHP33705 | AFS 5489.2.5 | 6 | | 10.9 | 2.2 | 28.6 | 49.9 | 8.3 |
| 396-fad2-1b/396b-sad3 | PHP33705 | AFS 5489.2.7 | 1 | | 7.4 | 12.6 | 70.4 | 2.9 | 6.7 |
| 396-fad2-1b/396b-sad3 | PHP33705 | AFS 5489.2.7 | 2 | | 7.9 | 7.6 | 71.1 | 3.8 | 9.5 |
| 396-fad2-1b/396b-sad3 | PHP33705 | AFS 5489.2.7 | 3 | | 6.7 | 12.1 | 72.9 | 2.5 | 5.8 |
| 396-fad2-1b/396b-sad3 | PHP33705 | AFS 5489.2.7 | 4 | | 7.8 | 11.6 | 65.3 | 5.6 | 9.7 |
| 396-fad2-1b/396b-sad3 | PHP33705 | AFS 5489.2.7 | 5 | | 7.2 | 14.6 | 68.2 | 1.8 | 8.2 |
| 396-fad2-1b/396b-sad3 | PHP33705 | AFS 5489.2.7 | 6 | | 7.8 | 8.1 | 72.2 | 3.2 | 8.6 |
| 396-fad2-1b/396b-sad3 | PHP33705 | AFS 5489.3.1 | 1 | | 11.5 | 2.8 | 24.0 | 50.3 | 11.5 |
| 396-fad2-1b/396b-sad3 | PHP33705 | AFS 5489.3.1 | 2 | | 6.6 | 13.2 | 64.4 | 4.8 | 11.0 |
| 396-fad2-1b/396b-sad3 | PHP33705 | AFS 5489.3.1 | 3 | | 6.3 | 16.4 | 65.0 | 3.4 | 8.9 |
| 396-fad2-1b/396b-sad3 | PHP33705 | AFS 5489.3.1 | 4 | | 6.5 | 14.1 | 64.2 | 5.1 | 10.0 |
| 396-fad2-1b/396b-sad3 | PHP33705 | AFS 5489.3.1 | 5 | | 6.1 | 17.9 | 64.3 | 3.5 | 8.1 |
| 396-fad2-1b/396b-sad3 | PHP33705 | AFS 5489.3.1 | 6 | | 10.8 | 3.7 | 58.9 | 11.5 | 15.1 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.3.3 | 1 | | 6.4 | 8.6 | 75.2 | 3.1 | 6.7 |
| 396-fad2-1b/396b-sad3 | PHP33705 | AFS 5489.3.3 | 2 | | 7.1 | 7.7 | 73.0 | 3.8 | 8.3 |
| 396-fad2-1b/396b-sad3 | PHP33705 | AFS 5489.3.3 | 3 | | 7.3 | 8.2 | 72.5 | 4.2 | 7.8 |
| 396-fad2-1b/396b-sad3 | PHP33705 | AFS 5489.3.3 | 4 | | 7.8 | 7.4 | 68.7 | 5.8 | 10.3 |
| 396-fad2-1b/396b-sad3 | PHP33705 | AFS 5489.3.3 | 5 | | 11.5 | 3.2 | 18.1 | 56.0 | 11.3 |
| 396-fad2-1b/396b-sad3 | PHP33705 | AFS 5489.3.3 | 6 | | 12.4 | 3.0 | 16.9 | 56.2 | 11.6 |
| 396-fad2-1b/396b-sad3 | PHP33705 | AFS 5489.3.7 | 1 | | 7.4 | 7.6 | 71.9 | 4.4 | 8.7 |
| 396-fad2-1b/396b-sad3 | PHP33705 | AFS 5489.3.7 | 2 | | 11.2 | 3.2 | 17.6 | 58.0 | 10.0 |
| 396-fad2-1b/396b-sad3 | PHP33705 | AFS 5489.3.7 | 3 | | 7.3 | 9.1 | 71.3 | 3.8 | 8.4 |
| 396-fad2-1b/396b-sad3 | PHP33705 | AFS 5489.3.7 | 4 | | 6.8 | 8.1 | 72.1 | 4.2 | 8.8 |
| 396-fad2-1b/396b-sad3 | PHP33705 | AFS 5489.3.7 | 5 | | 6.6 | 6.6 | 74.7 | 4.2 | 7.8 |
| 396-fad2-1b/396b-sad3 | PHP33705 | AFS 5489.3.7 | 6 | | 6.7 | 8.0 | 73.6 | 4.0 | 7.6 |
| 396-fad2-1b/396b-sad3 | PHP33705 | AFS 5489.4.2 | 1 | | 11.5 | 2.4 | 25.8 | 49.4 | 10.9 |
| 396-fad2-1b/396b-sad3 | PHP33705 | AFS 5489.4.2 | 2 | | 11.3 | 3.4 | 35.6 | 41.2 | 8.5 |
| 396-fad2-1b/396b-sad3 | PHP33705 | AFS 5489.4.2 | 3 | | 6.9 | 9.5 | 71.8 | 3.5 | 8.3 |
| 396-fad2-1b/396b-sad3 | PHP33705 | AFS 5489.4.2 | 4 | | 11.1 | 2.8 | 28.7 | 48.6 | 8.7 |
| 396-fad2-1b/396b-sad3 | PHP33705 | AFS 5489.4.2 | 5 | | 6.3 | 10.9 | 68.7 | 4.8 | 9.3 |
| 396-fad2-1b/396b-sad3 | PHP33705 | AFS 5489.4.2 | 6 | | 12.1 | 3.2 | 16.0 | 56.2 | 12.5 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.4.3 | 1 | | 6.5 | 9.3 | 74.3 | 3.2 | 6.7 |
| 396-fad2-1b/396b-sad3 | PHP33705 | AFS 5489.4.3 | 2 | | 7.1 | 12.3 | 70.6 | 2.7 | 7.3 |
| 396-fad2-1b/396b-sad3 | PHP33705 | AFS 5489.4.3 | 3 | | 10.6 | 2.7 | 29.9 | 48.3 | 8.5 |
| 396-fad2-1b/396b-sad3 | PHP33705 | AFS 5489.4.3 | 4 | | 11.6 | 2.2 | 22.7 | 53.6 | 9.9 |
| 396-fad2-1b/396b-sad3 | PHP33705 | AFS 5489.4.3 | 5 | | 7.1 | 13.0 | 71.7 | 1.4 | 6.9 |
| 396-fad2-1b/396b-sad3 | PHP33705 | AFS 5489.4.3 | 6 | | 6.8 | 13.1 | 70.4 | 2.9 | 6.8 |
| 396-fad2-1b/396b-sad3 | PHP33705 | AFS 5489.4.7 | 1 | | 11.6 | 3.2 | 19.3 | 54.2 | 11.7 |
| 396-fad2-1b/396b-sad3 | PHP33705 | AFS 5489.4.7 | 2 | | 11.4 | 3.2 | 20.5 | 54.0 | 10.9 |
| 396-fad2-1b/396b-sad3 | PHP33705 | AFS 5489.4.7 | 3 | | 11.8 | 3.1 | 19.3 | 53.1 | 12.7 |
| 396-fad2-1b/396b-sad3 | PHP33705 | AFS 5489.4.7 | 4 | | 12.3 | 3.1 | 16.4 | 55.8 | 12.4 |
| 396-fad2-1b/396b-sad3 | PHP33705 | AFS 5489.4.7 | 5 | | 12.6 | 3.1 | 10.3 | 54.9 | 19.0 |
| 396-fad2-1b/396b-sad3 | PHP33705 | AFS 5489.4.7 | 6 | | 12.2 | 3.3 | 19.7 | 54.9 | 9.9 |
| 396-fad2-1b/396b-sad3 | PHP33705 | AFS 5489.4.8 | 1 | | 6.7 | 14.4 | 68.7 | 3.0 | 7.3 |
| 396-fad2-1b/396b-sad3 | PHP33705 | AFS 5489.4.8 | 2 | | 13.2 | 2.6 | 14.6 | 52.6 | 17.0 |
| 396-fad2-1b/396b-sad3 | PHP33705 | AFS 5489.4.8 | 3 | | 6.3 | 14.9 | 67.9 | 3.6 | 7.3 |
| 396-fad2-1b/396b-sad3 | PHP33705 | AFS 5489.4.8 | 4 | | 7.9 | 8.6 | 68.9 | 5.3 | 9.3 |
| 396-fad2-1b/396b-sad3 | PHP33705 | AFS 5489.4.8 | 5 | | 6.4 | 12.1 | 69.3 | 4.2 | 8.0 |
| 396-fad2-1b/396b-sad3 | PHP33705 | AFS 5489.4.8 | 6 | | 11.7 | 2.7 | 21.8 | 54.7 | 9.1 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.3.2 | 1 | | 8.0 | 8.6 | 63.5 | 9.1 | 10.8 |
| 396-fad2-1b/396b-sad3 | PHP33705 | AFS 5489.3.2 | 2 | | 6.5 | 13.6 | 62.6 | 7.7 | 9.7 |
| 396-fad2-1b/396b-sad3 | PHP33705 | AFS 5489.3.2 | 3 | | 7.4 | 13.9 | 58.7 | 7.1 | 13.0 |
| 396-fad2-1b/396b-sad3 | PHP33705 | AFS 5489.3.2 | 4 | | 12.8 | 3.5 | 21.3 | 49.5 | 13.0 |
| 396-fad2-1b/396b-sad3 | PHP33705 | AFS 5489.3.2 | 5 | | 13.1 | 3.4 | 16.1 | 52.1 | 15.4 |
| 396-fad2-1b/396b-sad3 | PHP33705 | AFS 5489.3.2 | 6 | | 7.9 | 8.1 | 65.4 | 7.2 | 11.3 |
| 396-fad2-1b/396b-sad3 | PHP33705 | AFS 5489.3.2 | 7 | | 6.9 | 16.8 | 61.2 | 5.1 | 10.0 |
| 396-fad2-1b/396b-sad3 | PHP33705 | AFS 5489.3.2 | 8 | | 7.5 | 11.2 | 60.5 | 8.9 | 12.0 |
| 396-fad2-1b/396b-sad3 | PHP33705 | AFS 5489.3.2 | 9 | | 7.5 | 9.4 | 65.3 | 6.9 | 10.8 |
| 396-fad2-1b/396b-sad3 | PHP33705 | AFS 5489.3.2 | 10 | | 12.4 | 3.4 | 18.8 | 51.1 | 14.2 |
| 396-fad2-1b/396b-sad3 | PHP33705 | AFS 5489.3.2 | 11 | | 7.3 | 7.8 | 69.4 | 5.3 | 10.2 |
| 396-fad2-1b/396b-sad3 | PHP33705 | AFS 5489.3.2 | 12 | | 6.6 | 13.8 | 62.0 | 7.8 | 9.8 |
| 396-fad2-1b/396b-sad3 | PHP33705 | AFS 5489.3.2 | 13 | 10GR13-6 | 6.2 | 14.8 | 63.5 | 5.4 | 10.1 |
| 396-fad2-1b/396b-sad3 | PHP33705 | AFS 5489.3.2 | 14 | 10GR13-7 | 11.7 | 3.1 | 19.7 | 52.6 | 13.0 |
| 396-fad2-1b/396b-sad3 | PHP33705 | AFS 5489.3.2 | 15 | 10GR13-8 | 13.5 | 3.1 | 16.7 | 51.0 | 15.6 |
| 396-fad2-1b/396b-sad3 | PHP33705 | AFS 5489.3.2 | 16 | | 7.1 | 12.9 | 63.2 | 6.6 | 10.2 |
| 396-fad2-1b/396b-sad3 | PHP33705 | AFS 5489.3.2 | 17 | | 7.4 | 9.1 | 67.3 | 5.5 | 10.7 |
| 396-fad2-1b/396b-sad3 | PHP33705 | AFS 5489.3.2 | 18 | | 12.2 | 3.4 | 18.6 | 52.4 | 13.4 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.3.2 | 19 | | 7.6 | 7.9 | 64.7 | 7.4 | 12.4 |
| 396-fad2-1b/396b-sad3 | PHP33705 | AFS 5489.3.2 | 20 | | 13.2 | 3.2 | 19.1 | 49.4 | 15.2 |
| 396-fad2-1b/396b-sad3 | PHP33705 | AFS 5489.3.2 | 21 | | 7.1 | 12.7 | 60.1 | 8.9 | 11.2 |
| 396-fad2-1b/396b-sad3 | PHP33705 | AFS 5489.3.2 | 22 | | 8.3 | 6.8 | 63.6 | 9.6 | 11.7 |
| 396-fad2-1b/396b-sad3 | PHP33705 | AFS 5489.3.2 | 23 | | 6.5 | 13.1 | 62.5 | 7.0 | 10.8 |
| 396-fad2-1b/396b-sad3 | PHP33705 | AFS 5489.3.2 | 24 | | 7.7 | 9.7 | 60.0 | 11.3 | 11.3 |
| 396-fad2-1b/396b-sad3 | PHP33705 | AFS 5489.3.4 | 1 | | 7.5 | 7.2 | 69.8 | 7.1 | 8.4 |
| 396-fad2-1b/396b-sad3 | PHP33705 | AFS 5489.3.4 | 2 | | 6.8 | 10.7 | 69.1 | 4.6 | 8.8 |
| 396-fad2-1b/396b-sad3 | PHP33705 | AFS 5489.3.4 | 3 | 10GR13-14 | 6.8 | 13.3 | 66.2 | 5.1 | 8.6 |
| 396-fad2-1b/396b-sad3 | PHP33705 | AFS 5489.3.4 | 4 | 10GR13-15 | 6.0 | 16.6 | 66.0 | 3.9 | 7.5 |
| 396-fad2-1b/396b-sad3 | PHP33705 | AFS 5489.3.4 | 5 | | 6.6 | 9.7 | 72.7 | 3.0 | 7.9 |
| 396-fad2-1b/396b-sad3 | PHP33705 | AFS 5489.3.4 | 6 | | 8.8 | 6.2 | 64.5 | 8.6 | 12.0 |
| 396-fad2-1b/396b-sad3 | PHP33705 | AFS 5489.3.4 | 7 | 10GR13-16 | 6.2 | 11.7 | 71.1 | 3.5 | 7.6 |
| 396-fad2-1b/396b-sad3 | PHP33705 | AFS 5489.3.4 | 8 | 10GR13-17 | 11.2 | 3.2 | 15.0 | 58.3 | 12.3 |
| 396-fad2-1b/396b-sad3 | PHP33705 | AFS 5489.3.4 | 9 | | 8.7 | 6.7 | 63.8 | 10.2 | 10.7 |
| 396-fad2-1b/396b-sad3 | PHP33705 | AFS 5489.3.4 | 10 | | 7.1 | 9.0 | 72.6 | 3.4 | 7.9 |
| 396-fad2-1b/396b-sad3 | PHP33705 | AFS 5489.3.4 | 11 | | 6.2 | 13.5 | 67.5 | 4.1 | 8.7 |
| 396-fad2-1b/396b-sad3 | PHP33705 | AFS 5489.3.4 | 12 | | 7.2 | 9.0 | 70.8 | 4.0 | 8.9 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.3.4 | 13 | | 7.0 | 9.7 | 69.0 | 5.2 | 9.1 |
| 396-fad2-1b/396b-sad3 | PHP33705 | AFS 5489.3.4 | 14 | 10GR13-19 | 7.7 | 10.6 | 65.0 | 7.7 | 9.1 |
| 396-fad2-1b/396b-sad3 | PHP33705 | AFS 5489.3.4 | 15 | 10GR13-20 | 7.3 | 10.8 | 67.8 | 5.8 | 8.3 |
| 396-fad2-1b/396b-sad3 | PHP33705 | AFS 5489.3.4 | 16 | | 6.8 | 12.6 | 65.5 | 5.3 | 9.8 |
| 396-fad2-1b/396b-sad3 | PHP33705 | AFS 5489.3.4 | 17 | | 6.5 | 9.3 | 69.3 | 5.9 | 9.0 |
| 396-fad2-1b/396b-sad3 | PHP33705 | AFS 5489.3.4 | 18 | | 6.1 | 11.9 | 70.3 | 3.1 | 8.6 |
| 396-fad2-1b/396b-sad3 | PHP33705 | AFS 5489.3.4 | 19 | | 7.3 | 7.0 | 71.9 | 4.6 | 9.2 |
| 396-fad2-1b/396b-sad3 | PHP33705 | AFS 5489.3.4 | 20 | | 7.4 | 7.6 | 71.1 | 4.3 | 9.6 |
| 396-fad2-1b/396b-sad3 | PHP33705 | AFS 5489.3.4 | 21 | 10GR13-23 | 6.1 | 13.7 | 69.6 | 3.2 | 7.5 |
| 396-fad2-1b/396b-sad3 | PHP33705 | AFS 5489.3.4 | 22 | | 10.9 | 3.4 | 19.0 | 56.4 | 10.3 |
| 396-fad2-1b/396b-sad3 | PHP33705 | AFS 5489.3.4 | 23 | | 7.2 | 8.4 | 69.6 | 5.2 | 9.5 |
| 396-fad2-1b/396b-sad3 | PHP33705 | AFS 5489.3.4 | 24 | | 6.9 | 9.4 | 69.3 | 5.2 | 9.3 |
| 396-fad2-1b/396b-sad3 | PHP33705 | AFS 5489.3.11 | 1 | | 11.4 | 4.1 | 15.8 | 57.5 | 11.1 |
| 396-fad2-1b/396b-sad3 | PHP33705 | AFS 5489.3.11 | 2 | | 11.8 | 3.3 | 30.2 | 45.1 | 9.6 |
| 396-fad2-1b/396b-sad3 | PHP33705 | AFS 5489.3.11 | 3 | | 7.3 | 15.9 | 65.4 | 3.4 | 8.1 |
| 396-fad2-1b/396b-sad3 | PHP33705 | AFS 5489.3.11 | 4 | | 6.6 | 14.1 | 68.8 | 2.6 | 7.9 |
| 396-fad2-1b/396b-sad3 | PHP33705 | AFS 5489.3.11 | 5 | | 13.1 | 3.3 | 14.4 | 55.0 | 14.2 |
| 396-fad2-1b/396b-sad3 | PHP33705 | AFS 5489.3.11 | 6 | | 10.8 | 3.6 | 20.7 | 55.7 | 9.3 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.3.11 | 7 | | 13.7 | 4.7 | 29.4 | 46.2 | 6.0 |
| 396-fad2-1b/396b-sad3 | PHP33705 | AFS 5489.3.11 | 8 | | 5.5 | 23.6 | 63.9 | 1.6 | 5.4 |
| 396-fad2-1b/396b-sad3 | PHP33705 | AFS 5489.3.11 | 9 | | 5.2 | 17.6 | 68.8 | 2.4 | 6.0 |
| 396-fad2-1b/396b-sad3 | PHP33705 | AFS 5489.3.11 | 10 | | 5.6 | 15.0 | 70.4 | 3.4 | 5.6 |
| 396-fad2-1b/396b-sad3 | PHP33705 | AFS 5489.3.11 | 11 | | 12.2 | 3.5 | 19.7 | 53.8 | 10.8 |
| 396-fad2-1b/396b-sad3 | PHP33705 | AFS 5489.3.11 | 12 | | 5.6 | 10.9 | 72.9 | 4.3 | 6.2 |
| 396-fad2-1b/396b-sad3 | PHP33705 | AFS 5489.3.11 | 13 | | 8.2 | 12.1 | 58.2 | 8.6 | 12.8 |
| 396-fad2-1b/396b-sad3 | PHP33705 | AFS 5489.3.11 | 14 | | 11.7 | 3.6 | 13.7 | 57.6 | 13.4 |
| 396-fad2-1b/396b-sad3 | PHP33705 | AFS 5489.3.11 | 15 | | 6.6 | 24.9 | 59.4 | 2.6 | 6.5 |
| 396-fad2-1b/396b-sad3 | PHP33705 | AFS 5489.3.11 | 16 | | 8.2 | 8.8 | 61.8 | 10.0 | 11.3 |
| 396-fad2-1b/396b-sad3 | PHP33705 | AFS 5489.3.11 | 17 | | 11.2 | 3.6 | 32.4 | 44.6 | 8.1 |
| 396-fad2-1b/396b-sad3 | PHP33705 | AFS 5489.3.11 | 18 | | 6.7 | 13.2 | 72.0 | 1.8 | 6.3 |
| 396-fad2-1b/396b-sad3 | PHP33705 | AFS 5489.3.11 | 19 | | 6.4 | 15.9 | 67.4 | 2.8 | 7.6 |
| 396-fad2-1b/396b-sad3 | PHP33705 | AFS 5489.3.11 | 20 | | 11.6 | 3.5 | 17.7 | 54.3 | 12.9 |
| 396-fad2-1b/396b-sad3 | PHP33705 | AFS 5489.3.11 | 21 | | 6.4 | 23.5 | 61.2 | 2.1 | 6.8 |
| 396-fad2-1b/396b-sad3 | PHP33705 | AFS 5489.3.11 | 22 | | 7.4 | 12.7 | 66.5 | 2.9 | 10.5 |
| 396-fad2-1b/396b-sad3 | PHP33705 | AFS 5489.3.11 | 23 | | 7.7 | 14.4 | 68.1 | 2.1 | 7.7 |
| 396-fad2-1b/396b-sad3 | PHP33705 | AFS 5489.3.11 | 24 | | 8.1 | 15.2 | 65.1 | 2.9 | 8.7 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.4.1 | 1 | | 6.2 | 14.6 | 70.5 | 2.0 | 6.8 |
| 396-fad2-1b/396b-sad3 | PHP33705 | AFS 5489.4.1 | 2 | | 5.7 | 14.5 | 71.2 | 3.0 | 5.6 |
| 396-fad2-1b/396b-sad3 | PHP33705 | AFS 5489.4.1 | 3 | | 8.3 | 5.5 | 69.5 | 6.2 | 10.6 |
| 396-fad2-1b/396b-sad3 | PHP33705 | AFS 5489.4.1 | 4 | | 6.8 | 14.3 | 65.6 | 4.4 | 8.9 |
| 396-fad2-1b/396b-sad3 | PHP33705 | AFS 5489.4.1 | 5 | | 5.9 | 18.0 | 66.3 | 2.1 | 7.6 |
| 396-fad2-1b/396b-sad3 | PHP33705 | AFS 5489.4.1 | 6 | | 6.4 | 16.0 | 67.8 | 2.0 | 7.8 |
| 396-fad2-1b/396b-sad3 | PHP33705 | AFS 5489.4.1 | 7 | | 7.4 | 17.3 | 64.7 | 2.2 | 8.4 |
| 396-fad2-1b/396b-sad3 | PHP33705 | AFS 5489.4.1 | 8 | 10GR13-48 | 11.8 | 3.1 | 19.3 | 54.7 | 11.1 |
| 396-fad2-1b/396b-sad3 | PHP33705 | AFS 5489.4.1 | 9 | | 10.1 | 3.0 | 29.0 | 49.0 | 8.9 |
| 396-fad2-1b/396b-sad3 | PHP33705 | AFS 5489.4.1 | 10 | | 5.0 | 20.2 | 66.7 | 2.4 | 5.7 |
| 396-fad2-1b/396b-sad3 | PHP33705 | AFS 5489.4.1 | 11 | | 5.6 | 14.3 | 71.5 | 3.7 | 5.1 |
| 396-fad2-1b/396b-sad3 | PHP33705 | AFS 5489.4.1 | 12 | | 10.7 | 3.8 | 26.2 | 53.0 | 6.3 |
| 396-fad2-1b/396b-sad3 | PHP33705 | AFS 5489.4.1 | 13 | | 11.5 | 3.5 | 17.2 | 56.1 | 11.8 |
| 396-fad2-1b/396b-sad3 | PHP33705 | AFS 5489.4.1 | 14 | | 5.7 | 21.5 | 63.8 | 1.7 | 7.3 |
| 396-fad2-1b/396b-sad3 | PHP33705 | AFS 5489.4.1 | 15 | | 11.6 | 3.5 | 23.5 | 53.2 | 8.2 |
| 396-fad2-1b/396b-sad3 | PHP33705 | AFS 5489.4.1 | 16 | 10GR13-53 | 10.8 | 3.0 | 18.6 | 57.5 | 10.1 |
| 396-fad2-1b/396b-sad3 | PHP33705 | AFS 5489.4.1 | 17 | 10GR13-54 | 5.5 | 16.4 | 69.8 | 1.3 | 7.0 |
| 396-fad2-1b/396b-sad3 | PHP33705 | AFS 5489.4.1 | 18 | | 10.3 | 3.3 | 31.5 | 47.8 | 7.1 |

TABLE 7d-continued

Fatty acid profile for T1 seed analyzed from soy transformed with PHP33705, containing the 396-fad2-1b & 396b-sad3 amiRNAs grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 396-fad2-1b/396b-sad3 | PHP33705 | AFS 5489.4.1 | 19 | | 4.4 | 22.2 | 65.4 | 2.5 | 5.5 |
| 396-fad2-1b/396b-sad3 | PHP33705 | AFS 5489.4.1 | 20 | 10GR13-56 | 4.8 | 20.5 | 67.4 | 1.4 | 5.9 |
| 396-fad2-1b/396b-sad3 | PHP33705 | AFS 5489.4.1 | 21 | | 6.5 | 15.6 | 65.5 | 4.0 | 8.5 |
| 396-fad2-1b/396b-sad3 | PHP33705 | AFS 5489.4.1 | 22 | | 6.3 | 14.8 | 66.0 | 3.3 | 9.6 |
| 396-fad2-1b/396b-sad3 | PHP33705 | AFS 5489.4.1 | 23 | | 6.5 | 13.4 | 66.1 | 4.4 | 9.7 |
| 396-fad2-1b/396b-sad3 | PHP33705 | AFS 5489.4.1 | 24 | | 5.7 | 15.4 | 70.8 | 1.4 | 6.7 |

TABLE 7e

Fatty acid profile for T1 seed analyzed from soy transformed with PHP38557, containing the 159-fad3c amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad3c | PHP38557 | AFS 6272.1.4 | 1 | 10GR13-63 | 13.2 | 3.3 | 12.5 | 67.8 | 3.2 |
| 159-fad3c | PHP38557 | AFS 6272.1.4 | 2 | | 13.0 | 3.2 | 16.8 | 63.1 | 4.0 |
| 159-fad3c | PHP38557 | AFS 6272.1.4 | 3 | 10GR13-65 | 13.3 | 3.4 | 14.1 | 65.3 | 3.9 |
| 159-fad3c | PHP38557 | AFS 6272.1.4 | 4 | | 10.1 | 2.5 | 30.5 | 45.4 | 11.5 |
| 159-fad3c | PHP38557 | AFS 6272.1.4 | 5 | 10GR13-66 | 12.5 | 3.4 | 13.5 | 53.4 | 17.2 |
| 159-fad3c | PHP38557 | AFS 6272.1.4 | 6 | | 12.3 | 3.8 | 12.5 | 67.1 | 4.3 |
| 159-fad3c | PHP38557 | AFS 6272.1.4 | 7 | | 12.8 | 3.4 | 15.3 | 65.1 | 3.4 |
| 159-fad3c | PHP38557 | AFS 6272.1.4 | 8 | | 12.4 | 3.3 | 14.4 | 65.6 | 4.3 |
| 159-fad3c | PHP38557 | AFS 6272.1.4 | 9 | 10GR13-70 | 10.7 | 3.2 | 18.9 | 55.0 | 12.2 |
| 159-fad3c | PHP38557 | AFS 6272.1.4 | 10 | | 13.1 | 3.6 | 15.1 | 64.7 | 3.5 |
| 159-fad3c | PHP38557 | AFS 6272.1.4 | 11 | | 11.8 | 2.8 | 20.9 | 61.6 | 2.8 |
| 159-fad3c | PHP38557 | AFS 6272.1.4 | 12 | | 12.3 | 3.5 | 15.8 | 64.9 | 3.5 |
| 159-fad3c | PHP38557 | AFS 6272.1.4 | 13 | 10GR13-73 | 12.0 | 3.7 | 13.8 | 68.3 | 2.2 |
| 159-fad3c | PHP38557 | AFS 6272.1.4 | 14 | | 12.4 | 3.6 | 15.8 | 65.0 | 3.2 |
| 159-fad3c | PHP38557 | AFS 6272.1.4 | 15 | | 12.0 | 3.2 | 15.2 | 65.9 | 3.7 |
| 159-fad3c | PHP38557 | AFS 6272.1.4 | 16 | | 11.4 | 3.1 | 19.6 | 63.0 | 2.9 |
| 159-fad3c | PHP38557 | AFS 6272.1.4 | 17 | | 11.2 | 3.2 | 16.2 | 55.0 | 14.4 |
| 159-fad3c | PHP38557 | AFS 6272.1.4 | 18 | | 12.0 | 3.3 | 14.6 | 66.5 | 3.5 |
| 159-fad3c | PHP38557 | AFS 6272.1.4 | 19 | | 11.4 | 3.1 | 19.1 | 63.3 | 3.0 |
| 159-fad3c | PHP38557 | AFS 6272.2.1 | 1 | | 12.7 | 3.1 | 15.0 | 65.8 | 3.5 |
| 159-fad3c | PHP38557 | AFS 6272.2.1 | 2 | | 13.0 | 3.2 | 19.1 | 61.3 | 3.4 |
| 159-fad3c | PHP38557 | AFS 6272.2.1 | 3 | 10GR13-81 | 11.3 | 2.9 | 15.4 | 55.3 | 15.2 |
| 159-fad3c | PHP38557 | AFS 6272.2.1 | 4 | 10GR13-82 | 12.1 | 2.7 | 16.9 | 52.5 | 15.8 |
| 159-fad3c | PHP38557 | AFS 6272.2.1 | 5 | 10GR13-83 | 12.9 | 3.5 | 15.9 | 65.3 | 2.4 |
| 159-fad3c | PHP38557 | AFS 6272.2.1 | 6 | | 12.2 | 3.1 | 16.0 | 53.5 | 15.2 |
| 159-fad3c | PHP38557 | AFS 6272.2.1 | 7 | | 12.2 | 3.4 | 16.4 | 64.8 | 3.1 |
| 159-fad3c | PHP38557 | AFS 6272.2.1 | 8 | | 12.5 | 2.9 | 17.6 | 51.9 | 15.1 |
| 159-fad3c | PHP38557 | AFS 6272.2.1 | 9 | | 12.3 | 3.2 | 15.2 | 65.6 | 3.7 |
| 159-fad3c | PHP38557 | AFS 6272.2.1 | 10 | | 13.3 | 3.6 | 13.7 | 65.4 | 4.1 |
| 159-fad3c | PHP38557 | AFS 6272.2.1 | 11 | | 12.2 | 3.6 | 14.2 | 66.3 | 3.6 |
| 159-fad3c | PHP38557 | AFS 6272.2.1 | 12 | | 11.4 | 3.2 | 15.1 | 56.4 | 13.9 |
| 159-fad3c | PHP38557 | AFS 6272.2.1 | 13 | 10GR13-90 | 12.8 | 3.3 | 13.0 | 67.8 | 3.2 |
| 159-fad3c | PHP38557 | AFS 6272.2.1 | 14 | 10GR13-91 | 12.2 | 4.2 | 13.6 | 67.6 | 2.4 |
| 159-fad3c | PHP38557 | AFS 6272.2.1 | 15 | | 11.9 | 3.4 | 14.6 | 66.5 | 3.5 |
| 159-fad3c | PHP38557 | AFS 6272.2.1 | 16 | 10GR13-93 | 12.1 | 3.8 | 14.5 | 66.2 | 3.4 |
| 159-fad3c | PHP38557 | AFS 6272.2.1 | 17 | | 11.8 | 3.4 | 14.1 | 56.6 | 14.1 |
| 159-fad3c | PHP38557 | AFS 6272.2.1 | 18 | | 11.1 | 3.6 | 12.5 | 57.8 | 15.0 |

TABLE 7e-continued

Fatty acid profile for T1 seed analyzed from soy transformed with PHP38557, containing the 159-fad3c amiRNA grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad3c | PHP38557 | AFS 6272.2.1 | 19 | 10GR13-94 | 12.3 | 3.2 | 14.4 | 67.2 | 2.9 |
| 159-fad3c | PHP38557 | AFS 6272.2.3 | 1 | 10GR13-95 | 12.9 | 3.0 | 14.4 | 64.7 | 5.0 |
| 159-fad3c | PHP38557 | AFS 6272.2.3 | 2 | 10GR13-96 | 12.7 | 3.4 | 14.1 | 64.7 | 5.1 |
| 159-fad3c | PHP38557 | AFS 6272.2.3 | 3 | 10GR13-97 | 12.7 | 3.5 | 15.5 | 64.9 | 3.4 |
| 159-fad3c | PHP38557 | AFS 6272.2.3 | 4 | 10GR13-98 | 13.5 | 3.6 | 11.8 | 66.2 | 4.8 |
| 159-fad3c | PHP38557 | AFS 6272.2.3 | 5 | | 12.6 | 3.1 | 15.7 | 63.7 | 4.9 |
| 159-fad3c | PHP38557 | AFS 6272.2.3 | 6 | | 12.3 | 3.2 | 15.8 | 63.9 | 4.8 |
| 159-fad3c | PHP38557 | AFS 6272.2.3 | 7 | | 12.6 | 3.2 | 14.5 | 64.8 | 4.9 |
| 159-fad3c | PHP38557 | AFS 6272.2.3 | 8 | 10GR13-101 | 12.6 | 2.8 | 18.0 | 62.0 | 4.5 |
| 159-fad3c | PHP38557 | AFS 6272.2.3 | 9 | 10GR13-102 | 13.1 | 3.3 | 15.5 | 62.5 | 5.6 |
| 159-fad3c | PHP38557 | AFS 6272.2.3 | 10 | | 13.0 | 3.4 | 13.7 | 65.6 | 4.4 |
| 159-fad3c | PHP38557 | AFS 6272.2.3 | 11 | 10GR13-103 | 14.0 | 3.5 | 11.9 | 63.5 | 7.1 |
| 159-fad3c | PHP38557 | AFS 6272.2.3 | 12 | 10GR13-104 | 12.0 | 3.3 | 15.0 | 64.7 | 5.0 |
| 159-fad3c | PHP38557 | AFS 6272.2.3 | 13 | | 12.5 | 3.7 | 13.7 | 65.2 | 4.9 |
| 159-fad3c | PHP38557 | AFS 6272.2.3 | 14 | | 11.7 | 3.4 | 13.9 | 66.5 | 4.4 |
| 159-fad3c | PHP38557 | AFS 6272.2.3 | 15 | 10GR13-106 | 11.7 | 3.6 | 16.1 | 66.0 | 2.7 |
| 159-fad3c | PHP38557 | AFS 6272.2.3 | 16 | 10GR13-107 | 12.2 | 3.5 | 14.2 | 54.2 | 15.9 |
| 159-fad3c | PHP38557 | AFS 6272.2.3 | 17 | | 12.3 | 3.1 | 15.7 | 64.5 | 4.4 |
| 159-fad3c | PHP38557 | AFS 6272.2.3 | 18 | 10GR13-109 | 12.5 | 3.5 | 13.6 | 55.3 | 14.9 |
| 159-fad3c | PHP38557 | AFS 6272.2.3 | 19 | | 12.3 | 3.1 | 15.0 | 64.5 | 5.0 |

TABLE 7f

Fatty acid profile for T2 seed analyzed from soy transformed with PHP41103, containing the 159-fatBF amiRNA, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fatBF | PHP41103 | AFS 6671.1.4 | 1 | | 2.5 | 2.2 | 22.0 | 64.3 | 9.1 |
| 159-fatBF | PHP41103 | AFS 6671.1.4 | 2 | 10GR13-222 | 2.5 | 2.5 | 22.4 | 62.9 | 9.7 |
| 159-fatBF | PHP41103 | AFS 6671.1.4 | 3 | | 2.7 | 2.5 | 21.0 | 63.2 | 10.5 |
| 159-fatBF | PHP41103 | AFS 6671.1.4 | 4 | | 2.9 | 2.5 | 24.7 | 60.1 | 9.8 |
| 159-fatBF | PHP41103 | AFS 6671.1.4 | 5 | | 11.8 | 3.0 | 19.7 | 55.9 | 9.5 |
| 159-fatBF | PHP41103 | AFS 6671.1.4 | 6 | 10GR13-226 | 11.1 | 3.1 | 17.4 | 58.3 | 10.1 |
| 159-fatBF | PHP41103 | AFS 6671.1.4 | 7 | | 2.3 | 1.9 | 26.8 | 57.8 | 11.2 |
| 159-fatBF | PHP41103 | AFS 6671.1.4 | 8 | | 2.2 | 1.8 | 22.4 | 61.5 | 12.1 |
| 159-fatBF | PHP41103 | AFS 6671.1.4 | 9 | 10GR13-229 | 2.4 | 1.9 | 23.2 | 61.1 | 11.5 |
| 159-fatBF | PHP41103 | AFS 6671.1.4 | 10 | | 2.9 | 2.6 | 20.0 | 64.2 | 10.4 |
| 159-fatBF | PHP41103 | AFS 6671.1.4 | 11 | | 2.5 | 2.0 | 20.9 | 62.5 | 12.0 |
| 159-fatBF | PHP41103 | AFS 6671.1.4 | 12 | | 2.5 | 2.1 | 23.5 | 61.1 | 10.8 |
| 159-fatBF | PHP41103 | AFS 6671.1.4 | 13 | | 2.8 | 2.3 | 21.3 | 63.1 | 10.5 |
| 159-fatBF | PHP41103 | AFS 6671.1.4 | 14 | | 2.8 | 2.2 | 22.2 | 63.1 | 9.7 |
| 159-fatBF | PHP41103 | AFS 6671.1.4 | 15 | | 2.8 | 2.3 | 19.8 | 62.7 | 12.4 |
| 159-fatBF | PHP41103 | AFS 6671.1.4 | 16 | | 2.3 | 1.8 | 33.0 | 52.9 | 9.9 |
| 159-fatBF | PHP41103 | AFS 6671.1.4 | 17 | 10GR13-237 | 11.1 | 2.7 | 20.5 | 54.1 | 11.5 |
| 159-fatBF | PHP41103 | AFS 6671.1.4 | 18 | | 2.3 | 1.8 | 24.5 | 57.3 | 14.2 |
| 159-fatBF | PHP41103 | AFS 6671.1.4 | 19 | | 11.2 | 3.0 | 17.6 | 57.3 | 10.9 |
| 159-fatBF | PHP41103 | AFS 6671.1.4 | 20 | | 2.4 | 1.9 | 23.8 | 59.7 | 12.2 |
| 159-fatBF | PHP41103 | AFS 6671.1.4 | 21 | | 2.1 | 1.7 | 26.0 | 58.3 | 12.0 |
| 159-fatBF | PHP41103 | AFS 6671.1.6 | 1 | 10GR13-242 | 2.1 | 1.8 | 39.8 | 47.1 | 9.1 |
| 159-fatBF | PHP41103 | AFS 6671.1.6 | 2 | 10GR13-243 | 2.2 | 1.8 | 28.5 | 56.8 | 10.8 |
| 159-fatBF | PHP41103 | AFS 6671.1.6 | 3 | 10GR13-244 | 2.2 | 2.0 | 27.9 | 57.8 | 10.1 |
| 159-fatBF | PHP41103 | AFS 6671.1.6 | 4 | | 2.4 | 1.8 | 35.0 | 50.4 | 10.4 |
| 159-fatBF | PHP41103 | AFS 6671.1.6 | 5 | | 10.7 | 2.8 | 31.9 | 45.0 | 9.6 |
| 159-fatBF | PHP41103 | AFS 6671.1.6 | 6 | 10GR13-247 | 1.9 | 1.6 | 27.5 | 54.4 | 14.6 |
| 159-fatBF | PHP41103 | AFS 6671.1.6 | 7 | | 11.8 | 2.6 | 18.9 | 53.9 | 12.8 |
| 159-fatBF | PHP41103 | AFS 6671.1.6 | 8 | 10GR13-249 | 2.2 | 1.6 | 27.3 | 56.6 | 12.3 |
| 159-fatBF | PHP41103 | AFS 6671.1.6 | 9 | | 2.5 | 1.8 | 30.1 | 54.6 | 11.0 |
| 159-fatBF | PHP41103 | AFS 6671.1.6 | 10 | | 2.4 | 1.7 | 26.5 | 55.0 | 14.3 |
| 159-fatBF | PHP41103 | AFS 6671.1.6 | 11 | 10GR13-252 | 2.4 | 1.8 | 27.0 | 58.8 | 10.1 |
| 159-fatBF | PHP41103 | AFS 6671.1.6 | 12 | 10GR13-253 | 2.3 | 1.6 | 25.6 | 57.2 | 13.2 |
| 159-fatBF | PHP41103 | AFS 6671.1.6 | 13 | | 2.3 | 1.6 | 37.6 | 47.8 | 10.7 |
| 159-fatBF | PHP41103 | AFS 6671.1.6 | 14 | | 2.3 | 1.5 | 25.9 | 57.3 | 13.0 |
| 159-fatBF | PHP41103 | AFS 6671.1.6 | 15 | 10GR13-256 | 2.3 | 2.1 | 18.4 | 65.4 | 11.7 |
| 159-fatBF | PHP41103 | AFS 6671.1.6 | 16 | | 2.2 | 2.0 | 35.0 | 51.1 | 9.7 |
| 159-fatBF | PHP41103 | AFS 6671.1.6 | 17 | 10GR13-258 | 2.3 | 1.7 | 26.0 | 58.6 | 11.3 |
| 159-fatBF | PHP41103 | AFS 6671.1.6 | 18 | | 2.6 | 2.1 | 28.6 | 56.7 | 10.0 |
| 159-fatBF | PHP41103 | AFS 6671.1.6 | 19 | 10GR13-260 | 2.4 | 1.9 | 32.1 | 52.7 | 10.8 |
| 159-fatBF | PHP41103 | AFS 6671.1.6 | 20 | 10GR13-261 | 11.2 | 2.4 | 20.0 | 54.4 | 12.1 |
| 159-fatBF | PHP41103 | AFS 6671.1.6 | 21 | 10GR13-262 | 11.9 | 2.6 | 22.8 | 51.4 | 11.4 |

TABLE 7f-continued

Fatty acid profile for T2 seed analyzed from soy transformed with
PHP41103, containing the 159-fatBF amiRNA, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fatBF | PHP41103 | AFS 6671.3.1 | 1 | | 2.4 | 2.3 | 20.6 | 64.0 | 10.6 |
| 159-fatBF | PHP41103 | AFS 6671.3.1 | 2 | | 2.5 | 2.6 | 19.3 | 64.8 | 10.8 |
| 159-fatBF | PHP41103 | AFS 6671.3.1 | 3 | | 2.9 | 2.8 | 19.4 | 66.4 | 8.4 |
| 159-fatBF | PHP41103 | AFS 6671.3.1 | 4 | | 3.1 | 2.4 | 19.4 | 65.0 | 10.2 |
| 159-fatBF | PHP41103 | AFS 6671.3.1 | 5 | | 10.9 | 3.0 | 19.0 | 56.5 | 10.6 |
| 159-fatBF | PHP41103 | AFS 6671.3.1 | 6 | | 2.5 | 2.4 | 18.5 | 62.8 | 13.9 |
| 159-fatBF | PHP41103 | AFS 6671.3.1 | 7 | 10GR13-269 | 11.1 | 2.7 | 16.6 | 57.0 | 12.6 |
| 159-fatBF | PHP41103 | AFS 6671.3.1 | 8 | 10GR13-270 | 2.7 | 2.6 | 18.1 | 66.0 | 10.6 |
| 159-fatBF | PHP41103 | AFS 6671.3.1 | 9 | | 2.5 | 2.0 | 18.5 | 61.7 | 15.3 |
| 159-fatBF | PHP41103 | AFS 6671.3.1 | 10 | | 2.7 | 2.4 | 18.0 | 64.0 | 13.0 |
| 159-fatBF | PHP41103 | AFS 6671.3.1 | 11 | | 10.7 | 2.7 | 16.1 | 57.7 | 12.8 |
| 159-fatBF | PHP41103 | AFS 6671.3.1 | 12 | 10GR13-274 | 11.5 | 2.7 | 16.6 | 57.5 | 11.7 |
| 159-fatBF | PHP41103 | AFS 6671.3.1 | 13 | | 11.2 | 2.7 | 13.3 | 56.8 | 16.0 |
| 159-fatBF | PHP41103 | AFS 6671.3.1 | 14 | | 12.1 | 2.8 | 14.8 | 57.4 | 12.9 |
| 159-fatBF | PHP41103 | AFS 6671.3.1 | 15 | 10GR13-277 | 12.0 | 2.5 | 14.6 | 56.1 | 14.7 |
| 159-fatBF | PHP41103 | AFS 6671.3.1 | 16 | 10GR13-278 | 2.3 | 2.2 | 18.2 | 64.8 | 12.5 |
| 159-fatBF | PHP41103 | AFS 6671.3.1 | 17 | | 2.7 | 2.2 | 14.9 | 66.4 | 13.7 |
| 159-fatBF | PHP41103 | AFS 6671.3.1 | 18 | | 11.6 | 2.7 | 16.0 | 56.0 | 13.7 |
| 159-fatBF | PHP41103 | AFS 6671.3.1 | 19 | | 11.5 | 3.2 | 14.6 | 54.5 | 16.1 |
| 159-fatBF | PHP41103 | AFS 6671.3.1 | 20 | | 2.7 | 2.3 | 17.3 | 64.9 | 12.8 |
| 159-fatBF | PHP41103 | AFS 6671.3.1 | 21 | | 11.2 | 2.8 | 15.4 | 58.2 | 12.3 |
| 159-fatBF | PHP41103 | AFS 6671.3.2 | 1 | | 2.7 | 2.1 | 21.9 | 63.0 | 10.4 |
| 159-fatBF | PHP41103 | AFS 6671.3.2 | 2 | | 2.8 | 2.0 | 25.3 | 60.3 | 9.6 |
| 159-fatBF | PHP41103 | AFS 6671.3.2 | 3 | | 3.2 | 2.5 | 24.6 | 60.2 | 9.4 |
| 159-fatBF | PHP41103 | AFS 6671.3.2 | 4 | | 10.8 | 3.1 | 22.5 | 53.8 | 9.7 |
| 159-fatBF | PHP41103 | AFS 6671.3.2 | 5 | | 11.6 | 3.0 | 19.4 | 56.0 | 9.9 |
| 159-fatBF | PHP41103 | AFS 6671.3.2 | 6 | | 2.4 | 2.0 | 32.9 | 52.2 | 10.6 |
| 159-fatBF | PHP41103 | AFS 6671.3.2 | 7 | | 11.9 | 2.8 | 19.1 | 54.8 | 11.4 |
| 159-fatBF | PHP41103 | AFS 6671.3.2 | 8 | | 2.7 | 2.1 | 27.9 | 57.8 | 9.5 |
| 159-fatBF | PHP41103 | AFS 6671.3.2 | 9 | | 2.6 | 2.1 | 23.8 | 60.2 | 11.3 |
| 159-fatBF | PHP41103 | AFS 6671.3.2 | 10 | | 2.7 | 2.1 | 18.4 | 64.7 | 12.1 |
| 159-fatBF | PHP41103 | AFS 6671.3.2 | 11 | | 2.9 | 2.1 | 24.6 | 59.9 | 10.6 |
| 159-fatBF | PHP41103 | AFS 6671.3.2 | 12 | | 2.5 | 2.4 | 24.0 | 58.6 | 12.6 |
| 159-fatBF | PHP41103 | AFS 6671.3.2 | 13 | | 11.1 | 2.5 | 21.4 | 54.5 | 10.5 |
| 159-fatBF | PHP41103 | AFS 6671.3.2 | 14 | | 2.8 | 2.2 | 21.0 | 61.9 | 12.1 |
| 159-fatBF | PHP41103 | AFS 6671.3.2 | 15 | | 2.4 | 1.8 | 20.6 | 61.6 | 13.5 |
| 159-fatBF | PHP41103 | AFS 6671.3.2 | 16 | | 2.2 | 1.8 | 34.9 | 49.2 | 11.8 |
| 159-fatBF | PHP41103 | AFS 6671.3.2 | 17 | | 2.3 | 1.8 | 25.8 | 58.7 | 11.4 |
| 159-fatBF | PHP41103 | AFS 6671.3.2 | 18 | | 2.9 | 2.2 | 26.4 | 58.6 | 9.8 |
| 159-fatBF | PHP41103 | AFS 6671.3.2 | 19 | | 11.7 | 3.0 | 16.7 | 53.1 | 15.5 |
| 159-fatBF | PHP41103 | AFS 6671.3.2 | 20 | | 2.4 | 2.2 | 14.8 | 67.2 | 13.4 |
| 159-fatBF | PHP41103 | AFS 6671.3.2 | 21 | | 2.5 | 2.0 | 23.7 | 60.2 | 11.6 |
| 159-fatBF | PHP41103 | AFS 6671.4.2 | 1 | | 2.4 | 2.6 | 16.8 | 67.5 | 10.7 |
| 159-fatBF | PHP41103 | AFS 6671.4.2 | 2 | | 2.5 | 2.1 | 26.6 | 59.0 | 9.7 |
| 159-fatBF | PHP41103 | AFS 6671.4.2 | 3 | | 3.1 | 3.1 | 17.1 | 65.6 | 11.1 |
| 159-fatBF | PHP41103 | AFS 6671.4.2 | 4 | | 3.3 | 2.3 | 24.5 | 60.8 | 9.1 |
| 159-fatBF | PHP41103 | AFS 6671.4.2 | 5 | | 11.4 | 3.0 | 20.4 | 54.2 | 11.0 |
| 159-fatBF | PHP41103 | AFS 6671.4.2 | 6 | | 10.5 | 2.3 | 20.3 | 54.7 | 12.2 |
| 159-fatBF | PHP41103 | AFS 6671.4.2 | 7 | | 3.0 | 2.2 | 19.0 | 63.0 | 12.8 |
| 159-fatBF | PHP41103 | AFS 6671.4.2 | 8 | | 11.5 | 3.3 | 16.6 | 55.7 | 12.9 |
| 159-fatBF | PHP41103 | AFS 6671.4.2 | 9 | | 11.4 | 3.0 | 17.6 | 55.8 | 12.1 |
| 159-fatBF | PHP41103 | AFS 6671.4.2 | 10 | | 11.1 | 3.2 | 19.4 | 54.8 | 11.4 |
| 159-fatBF | PHP41103 | AFS 6671.4.2 | 11 | | 11.1 | 2.9 | 15.8 | 58.2 | 12.1 |
| 159-fatBF | PHP41103 | AFS 6671.4.2 | 12 | | 2.7 | 2.0 | 25.4 | 59.2 | 10.7 |
| 159-fatBF | PHP41103 | AFS 6671.4.2 | 13 | | 2.3 | 1.9 | 25.8 | 59.0 | 11.1 |
| 159-fatBF | PHP41103 | AFS 6671.4.2 | 14 | | 3.1 | 2.2 | 21.0 | 62.0 | 11.8 |
| 159-fatBF | PHP41103 | AFS 6671.4.2 | 15 | | 2.6 | 2.1 | 23.4 | 60.2 | 11.7 |
| 159-fatBF | PHP41103 | AFS 6671.4.2 | 16 | | 2.8 | 2.7 | 17.1 | 63.6 | 13.8 |
| 159-fatBF | PHP41103 | AFS 6671.4.2 | 17 | | 2.6 | 2.8 | 19.9 | 63.0 | 11.7 |
| 159-fatBF | PHP41103 | AFS 6671.4.2 | 18 | | 11.1 | 3.0 | 17.3 | 57.3 | 11.4 |
| 159-fatBF | PHP41103 | AFS 6671.4.2 | 19 | | 10.9 | 2.7 | 19.4 | 55.4 | 11.6 |
| 159-fatBF | PHP41103 | AFS 6671.4.2 | 20 | | 3.0 | 2.3 | 19.0 | 63.3 | 12.4 |
| 159-fatBF | PHP41103 | AFS 6671.4.2 | 21 | | 2.5 | 2.6 | 18.9 | 63.9 | 12.1 |
| 159-fatBF | PHP41103 | AFS 6671.6.1 | 1 | | 2.3 | 2.1 | 19.7 | 65.3 | 10.6 |
| 159-fatBF | PHP41103 | AFS 6671.6.1 | 2 | | 2.6 | 2.1 | 26.8 | 60.8 | 7.7 |
| 159-fatBF | PHP41103 | AFS 6671.6.1 | 3 | 10GR13-286 | 11.4 | 3.5 | 17.0 | 57.4 | 10.7 |
| 159-fatBF | PHP41103 | AFS 6671.6.1 | 4 | | 12.4 | 3.2 | 14.5 | 58.9 | 11.0 |
| 159-fatBF | PHP41103 | AFS 6671.6.1 | 5 | 10GR13-288 | 12.5 | 3.3 | 13.0 | 59.0 | 12.3 |
| 159-fatBF | PHP41103 | AFS 6671.6.1 | 6 | 10GR13-289 | 2.3 | 2.4 | 18.0 | 65.7 | 11.7 |
| 159-fatBF | PHP41103 | AFS 6671.6.1 | 7 | | 2.8 | 2.3 | 16.4 | 66.7 | 11.7 |
| 159-fatBF | PHP41103 | AFS 6671.6.1 | 8 | | 11.2 | 2.9 | 16.2 | 56.9 | 12.8 |
| 159-fatBF | PHP41103 | AFS 6671.6.1 | 9 | | 2.5 | 2.2 | 18.7 | 66.1 | 10.4 |
| 159-fatBF | PHP41103 | AFS 6671.6.1 | 10 | | 2.4 | 2.4 | 15.8 | 65.2 | 14.3 |
| 159-fatBF | PHP41103 | AFS 6671.6.1 | 11 | | 2.6 | 2.2 | 15.6 | 67.7 | 12.0 |

TABLE 7f-continued

Fatty acid profile for T2 seed analyzed from soy transformed with PHP41103, containing the 159-fatBF amiRNA, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fatBF | PHP41103 | AFS 6671.6.1 | 12 | | 2.4 | 1.8 | 22.7 | 60.9 | 12.1 |
| 159-fatBF | PHP41103 | AFS 6671.6.1 | 13 | | 11.1 | 3.3 | 17.1 | 55.7 | 12.8 |
| 159-fatBF | PHP41103 | AFS 6671.6.1 | 14 | | 2.3 | 2.4 | 16.5 | 65.7 | 13.1 |
| 159-fatBF | PHP41103 | AFS 6671.6.1 | 15 | | 2.4 | 2.1 | 16.2 | 66.3 | 12.9 |
| 159-fatBF | PHP41103 | AFS 6671.6.1 | 16 | | 2.5 | 2.5 | 17.0 | 64.3 | 13.7 |
| 159-fatBF | PHP41103 | AFS 6671.6.1 | 17 | | 10.8 | 3.1 | 14.2 | 58.2 | 13.7 |
| 159-fatBF | PHP41103 | AFS 6671.6.1 | 18 | | 2.6 | 2.1 | 20.9 | 63.1 | 11.3 |
| 159-fatBF | PHP41103 | AFS 6671.6.1 | 19 | | 2.3 | 1.8 | 20.1 | 62.8 | 13.0 |
| 159-fatBF | PHP41103 | AFS 6671.6.1 | 20 | | 2.3 | 2.3 | 14.1 | 68.2 | 13.0 |
| 159-fatBF | PHP41103 | AFS 6671.6.1 | 21 | 10GR13-304 | 2.4 | 2.5 | 15.5 | 67.8 | 11.8 |
| 159-fatBF | PHP41103 | AFS 6671.6.3 | 1 | | 2.8 | 2.8 | 16.5 | 66.0 | 11.9 |
| 159-fatBF | PHP41103 | AFS 6671.6.3 | 2 | | 4.0 | 2.9 | 19.1 | 64.1 | 9.9 |
| 159-fatBF | PHP41103 | AFS 6671.6.3 | 3 | 10GR13-307 | 4.1 | 2.6 | 17.7 | 65.3 | 10.2 |
| 159-fatBF | PHP41103 | AFS 6671.6.3 | 4 | | 13.3 | 3.6 | 12.3 | 57.5 | 13.3 |
| 159-fatBF | PHP41103 | AFS 6671.6.3 | 5 | 10GR13-309 | 13.3 | 3.2 | 15.3 | 57.2 | 11.0 |
| 159-fatBF | PHP41103 | AFS 6671.6.3 | 6 | 10GR13-310 | 3.4 | 2.6 | 17.9 | 65.3 | 10.9 |
| 159-fatBF | PHP41103 | AFS 6671.6.3 | 7 | | 3.7 | 2.7 | 15.3 | 63.9 | 14.4 |
| 159-fatBF | PHP41103 | AFS 6671.6.3 | 8 | | 3.3 | 2.7 | 15.5 | 61.3 | 17.2 |
| 159-fatBF | PHP41103 | AFS 6671.6.3 | 9 | 10GR13-313 | 2.9 | 2.4 | 19.4 | 63.2 | 12.1 |
| 159-fatBF | PHP41103 | AFS 6671.6.3 | 10 | | 3.9 | 2.9 | 15.0 | 65.4 | 12.8 |
| 159-fatBF | PHP41103 | AFS 6671.6.3 | 11 | | 3.8 | 2.6 | 15.5 | 64.3 | 13.8 |
| 159-fatBF | PHP41103 | AFS 6671.6.3 | 12 | | 2.9 | 2.3 | 14.6 | 65.2 | 15.0 |
| 159-fatBF | PHP41103 | AFS 6671.6.3 | 13 | | 3.4 | 2.1 | 17.6 | 64.6 | 12.3 |
| 159-fatBF | PHP41103 | AFS 6671.6.3 | 14 | 10GR13-318 | 11.2 | 3.0 | 14.4 | 58.3 | 13.2 |
| 159-fatBF | PHP41103 | AFS 6671.6.3 | 15 | | 3.0 | 2.1 | 16.0 | 64.3 | 14.7 |
| 159-fatBF | PHP41103 | AFS 6671.6.3 | 16 | | 11.4 | 3.2 | 13.2 | 57.9 | 14.4 |
| 159-fatBF | PHP41103 | AFS 6671.6.3 | 17 | 10GR13-321 | 2.8 | 2.5 | 15.7 | 63.8 | 15.1 |
| 159-fatBF | PHP41103 | AFS 6671.6.3 | 18 | | 3.6 | 2.3 | 19.5 | 61.1 | 13.5 |
| 159-fatBF | PHP41103 | AFS 6671.6.3 | 19 | | 2.8 | 2.5 | 13.4 | 66.3 | 15.0 |
| 159-fatBF | PHP41103 | AFS 6671.6.3 | 20 | | 11.4 | 3.2 | 14.1 | 55.7 | 15.5 |
| 159-fatBF | PHP41103 | AFS 6671.6.3 | 21 | | 3.6 | 2.6 | 18.3 | 63.5 | 12.0 |
| 159-fatBF | PHP41103 | AFS 6671.10.4 | 1 | | 2.2 | 2.1 | 32.6 | 53.0 | 10.2 |
| 159-fatBF | PHP41103 | AFS 6671.10.4 | 2 | | 2.3 | 1.9 | 32.8 | 53.1 | 9.8 |
| 159-fatBF | PHP41103 | AFS 6671.10.4 | 3 | | 2.4 | 1.9 | 39.4 | 47.2 | 9.1 |
| 159-fatBF | PHP41103 | AFS 6671.10.4 | 4 | | 2.5 | 2.3 | 17.2 | 66.1 | 11.9 |
| 159-fatBF | PHP41103 | AFS 6671.10.4 | 5 | | 11.4 | 2.7 | 26.5 | 51.2 | 8.2 |
| 159-fatBF | PHP41103 | AFS 6671.10.4 | 6 | | 11.3 | 2.6 | 20.4 | 52.3 | 13.4 |
| 159-fatBF | PHP41103 | AFS 6671.10.4 | 7 | | 11.3 | 2.2 | 23.2 | 52.2 | 11.3 |
| 159-fatBF | PHP41103 | AFS 6671.10.4 | 8 | | 11.7 | 3.2 | 15.9 | 54.9 | 14.3 |
| 159-fatBF | PHP41103 | AFS 6671.10.4 | 9 | | 2.3 | 2.0 | 19.1 | 62.8 | 13.8 |
| 159-fatBF | PHP41103 | AFS 6671.10.4 | 10 | | 2.3 | 2.3 | 18.0 | 64.5 | 12.9 |
| 159-fatBF | PHP41103 | AFS 6671.10.4 | 11 | | 11.0 | 2.5 | 24.2 | 50.9 | 11.5 |
| 159-fatBF | PHP41103 | AFS 6671.10.4 | 12 | | 2.1 | 1.4 | 37.9 | 48.2 | 10.4 |
| 159-fatBF | PHP41103 | AFS 6671.10.4 | 13 | | 10.9 | 3.1 | 13.5 | 58.8 | 13.8 |
| 159-fatBF | PHP41103 | AFS 6671.10.4 | 14 | | 11.9 | 3.0 | 12.3 | 54.3 | 18.5 |
| 159-fatBF | PHP41103 | AFS 6671.10.4 | 15 | | 2.0 | 2.2 | 14.8 | 64.3 | 16.7 |
| 159-fatBF | PHP41103 | AFS 6671.10.4 | 16 | | 11.5 | 3.3 | 12.4 | 56.2 | 16.5 |
| 159-fatBF | PHP41103 | AFS 6671.10.4 | 17 | | 2.5 | 2.1 | 17.4 | 64.7 | 13.2 |
| 159-fatBF | PHP41103 | AFS 6671.10.4 | 18 | | 2.2 | 1.7 | 19.5 | 64.0 | 12.5 |
| 159-fatBF | PHP41103 | AFS 6671.10.4 | 19 | | 11.8 | 2.5 | 13.8 | 55.4 | 16.5 |
| 159-fatBF | PHP41103 | AFS 6671.10.4 | 20 | | 11.2 | 3.0 | 14.1 | 57.8 | 14.0 |
| 159-fatBF | PHP41103 | AFS 6671.10.4 | 21 | | 2.5 | 1.5 | 27.0 | 56.0 | 13.0 |
| 159-fatBF | PHP41103 | AFS 6671.11.2 | 1 | | 2.3 | 1.9 | 28.8 | 56.1 | 10.9 |
| 159-fatBF | PHP41103 | AFS 6671.11.2 | 2 | | 2.3 | 2.1 | 37.8 | 47.8 | 9.9 |
| 159-fatBF | PHP41103 | AFS 6671.11.2 | 3 | 10GR13-328 | 11.3 | 2.8 | 21.6 | 52.9 | 11.5 |
| 159-fatBF | PHP41103 | AFS 6671.11.2 | 4 | 10GR13-329 | 11.8 | 2.7 | 21.9 | 53.2 | 10.4 |
| 159-fatBF | PHP41103 | AFS 6671.11.2 | 5 | 10GR13-330 | 12.3 | 3.0 | 19.6 | 54.1 | 11.0 |
| 159-fatBF | PHP41103 | AFS 6671.11.2 | 6 | 10GR13-331 | 2.4 | 2.3 | 24.2 | 58.2 | 13.0 |
| 159-fatBF | PHP41103 | AFS 6671.11.2 | 7 | | 2.6 | 2.3 | 22.7 | 60.5 | 11.9 |
| 159-fatBF | PHP41103 | AFS 6671.11.2 | 8 | 10GR13-333 | 2.5 | 2.1 | 18.4 | 64.5 | 12.6 |
| 159-fatBF | PHP41103 | AFS 6671.11.2 | 9 | 10GR13-334 | 2.3 | 2.4 | 16.9 | 65.4 | 13.0 |
| 159-fatBF | PHP41103 | AFS 6671.11.2 | 10 | | 3.0 | 2.2 | 21.2 | 61.1 | 12.5 |
| 159-fatBF | PHP41103 | AFS 6671.11.2 | 11 | | 2.3 | 1.8 | 18.2 | 62.5 | 15.2 |
| 159-fatBF | PHP41103 | AFS 6671.11.2 | 12 | | 11.5 | 3.0 | 19.3 | 52.8 | 13.4 |
| 159-fatBF | PHP41103 | AFS 6671.11.2 | 13 | | 2.5 | 2.4 | 13.3 | 62.0 | 19.8 |
| 159-fatBF | PHP41103 | AFS 6671.11.2 | 14 | | 2.4 | 2.1 | 19.7 | 63.2 | 12.7 |
| 159-fatBF | PHP41103 | AFS 6671.11.2 | 15 | | 2.6 | 1.7 | 21.3 | 59.8 | 14.6 |
| 159-fatBF | PHP41103 | AFS 6671.11.2 | 16 | 10GR13-341 | 2.8 | 2.4 | 14.7 | 65.9 | 14.1 |
| 159-fatBF | PHP41103 | AFS 6671.11.2 | 17 | | 2.5 | 1.7 | 32.1 | 51.1 | 12.5 |
| 159-fatBF | PHP41103 | AFS 6671.11.2 | 18 | | 2.6 | 2.1 | 28.6 | 55.2 | 11.6 |
| 159-fatBF | PHP41103 | AFS 6671.11.2 | 19 | | 3.0 | 2.1 | 18.4 | 65.0 | 11.5 |
| 159-fatBF | PHP41103 | AFS 6671.11.2 | 20 | | 2.7 | 1.7 | 14.3 | 65.7 | 15.5 |
| 159-fatBF | PHP41103 | AFS 6671.11.2 | 21 | | 2.5 | 1.8 | 29.7 | 53.2 | 12.9 |
| 159-fatBF | PHP41103 | AFS 6671.11.3 | 1 | 10GR13-347 | 2.2 | 2.2 | 22.6 | 61.7 | 11.4 |

TABLE 7f-continued

Fatty acid profile for T2 seed analyzed from soy transformed with
PHP41103, containing the 159-fatBF amiRNA, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fatBF | PHP41103 | AFS 6671.11.3 | 2 | | 2.4 | 2.2 | 24.0 | 61.8 | 9.6 |
| 159-fatBF | PHP41103 | AFS 6671.11.3 | 3 | | 2.7 | 2.0 | 21.8 | 62.8 | 10.8 |
| 159-fatBF | PHP41103 | AFS 6671.11.3 | 4 | | 2.7 | 2.2 | 21.4 | 63.6 | 10.1 |
| 159-fatBF | PHP41103 | AFS 6671.11.3 | 5 | | 3.2 | 2.6 | 16.0 | 67.9 | 10.3 |
| 159-fatBF | PHP41103 | AFS 6671.11.3 | 6 | | 3.2 | 2.4 | 18.4 | 64.7 | 11.4 |
| 159-fatBF | PHP41103 | AFS 6671.11.3 | 7 | 10GR13-353 | 11.6 | 2.7 | 16.4 | 56.5 | 12.7 |
| 159-fatBF | PHP41103 | AFS 6671.11.3 | 8 | | 2.4 | 1.9 | 18.8 | 63.6 | 13.2 |
| 159-fatBF | PHP41103 | AFS 6671.11.3 | 9 | 10GR13-355 | 2.0 | 1.7 | 16.2 | 65.3 | 14.7 |
| 159-fatBF | PHP41103 | AFS 6671.11.3 | 10 | | 3.1 | 2.4 | 20.4 | 62.6 | 11.5 |
| 159-fatBF | PHP41103 | AFS 6671.11.3 | 11 | | | | | | |
| 159-fatBF | PHP41103 | AFS 6671.11.3 | 12 | | 12.2 | 2.7 | 11.9 | 53.3 | 19.9 |
| 159-fatBF | PHP41103 | AFS 6671.11.3 | 13 | 10GR13-359 | 12.1 | 2.4 | 12.3 | 57.9 | 15.2 |
| 159-fatBF | PHP41103 | AFS 6671.11.3 | 14 | 10GR13-360 | 3.2 | 2.2 | 20.0 | 63.5 | 11.2 |
| 159-fatBF | PHP41103 | AFS 6671.11.3 | 15 | | 2.4 | 2.2 | 16.0 | 65.7 | 13.6 |
| 159-fatBF | PHP41103 | AFS 6671.11.3 | 16 | | 2.2 | 2.2 | 16.4 | 64.2 | 14.9 |
| 159-fatBF | PHP41103 | AFS 6671.11.3 | 17 | | 2.3 | 1.7 | 23.2 | 60.3 | 12.5 |
| 159-fatBF | PHP41103 | AFS 6671.11.3 | 18 | | 2.4 | 1.6 | 27.5 | 57.2 | 11.3 |
| 159-fatBF | PHP41103 | AFS 6671.11.3 | 19 | | 2.6 | 1.8 | 20.6 | 63.6 | 11.5 |
| 159-fatBF | PHP41103 | AFS 6671.11.3 | 20 | | 2.7 | 2.5 | 18.0 | 65.6 | 11.2 |
| 159-fatBF | PHP41103 | AFS 6671.11.3 | 21 | 10GR13-367 | 2.3 | 2.3 | 13.7 | 67.3 | 14.5 |
| 159-fatBF | PHP41103 | AFS 6671.11.4 | 1 | | 2.1 | 2.1 | 24.9 | 60.9 | 10.0 |
| 159-fatBF | PHP41103 | AFS 6671.11.4 | 2 | | 2.6 | 2.2 | 33.0 | 54.1 | 8.1 |
| 159-fatBF | PHP41103 | AFS 6671.11.4 | 3 | | 2.6 | 2.0 | 30.0 | 55.6 | 9.8 |
| 159-fatBF | PHP41103 | AFS 6671.11.4 | 4 | | 2.8 | 2.0 | 42.3 | 44.8 | 8.2 |
| 159-fatBF | PHP41103 | AFS 6671.11.4 | 5 | | 11.0 | 2.8 | 33.3 | 44.3 | 8.6 |
| 159-fatBF | PHP41103 | AFS 6671.11.4 | 6 | | 11.1 | 2.3 | 16.6 | 55.8 | 14.2 |
| 159-fatBF | PHP41103 | AFS 6671.11.4 | 7 | | 2.4 | 1.8 | 20.4 | 63.7 | 11.7 |
| 159-fatBF | PHP41103 | AFS 6671.11.4 | 8 | | 2.8 | 1.7 | 22.4 | 60.8 | 12.3 |
| 159-fatBF | PHP41103 | AFS 6671.11.4 | 9 | | 10.9 | 2.5 | 24.5 | 50.8 | 11.3 |
| 159-fatBF | PHP41103 | AFS 6671.11.4 | 10 | | 2.4 | 1.8 | 23.9 | 59.9 | 11.9 |
| 159-fatBF | PHP41103 | AFS 6671.11.4 | 11 | | 2.2 | 1.9 | 20.8 | 62.5 | 12.6 |
| 159-fatBF | PHP41103 | AFS 6671.11.4 | 12 | | 11.0 | 2.5 | 24.6 | 51.3 | 10.6 |
| 159-fatBF | PHP41103 | AFS 6671.11.4 | 13 | | 11.3 | 2.8 | 18.3 | 54.2 | 13.4 |
| 159-fatBF | PHP41103 | AFS 6671.11.4 | 14 | | 11.1 | 2.7 | 20.1 | 55.8 | 10.3 |
| 159-fatBF | PHP41103 | AFS 6671.11.4 | 15 | | 2.3 | 1.5 | 16.2 | 64.4 | 15.7 |
| 159-fatBF | PHP41103 | AFS 6671.11.4 | 16 | | 11.7 | 2.2 | 15.3 | 58.5 | 12.2 |
| 159-fatBF | PHP41103 | AFS 6671.11.4 | 17 | | 2.6 | 1.8 | 23.3 | 60.9 | 11.4 |
| 159-fatBF | PHP41103 | AFS 6671.11.4 | 18 | | 11.5 | 2.5 | 24.4 | 49.9 | 11.7 |
| 159-fatBF | PHP41103 | AFS 6671.11.4 | 19 | | 11.0 | 2.6 | 22.6 | 52.3 | 11.5 |
| 159-fatBF | PHP41103 | AFS 6671.11.4 | 20 | | 11.3 | 2.5 | 19.0 | 55.2 | 12.1 |
| 159-fatBF | PHP41103 | AFS 6671.11.4 | 21 | | 2.8 | 1.9 | 27.1 | 57.1 | 11.1 |
| 159-fatBF | PHP41103 | AFS 6671.12.2 | 1 | | 2.4 | 2.0 | 29.5 | 56.9 | 9.2 |
| 159-fatBF | PHP41103 | AFS 6671.12.2 | 2 | | 2.4 | 2.1 | 37.9 | 48.3 | 9.3 |
| 159-fatBF | PHP41103 | AFS 6671.12.2 | 3 | | 11.6 | 3.0 | 23.4 | 53.3 | 8.7 |
| 159-fatBF | PHP41103 | AFS 6671.12.2 | 4 | | 11.7 | 2.8 | 23.1 | 53.1 | 9.4 |
| 159-fatBF | PHP41103 | AFS 6671.12.2 | 5 | | 11.8 | 3.1 | 21.3 | 55.0 | 8.8 |
| 159-fatBF | PHP41103 | AFS 6671.12.2 | 6 | | 2.2 | 1.7 | 28.0 | 56.5 | 11.6 |
| 159-fatBF | PHP41103 | AFS 6671.12.2 | 7 | | 11.7 | 2.7 | 14.6 | 57.2 | 13.8 |
| 159-fatBF | PHP41103 | AFS 6671.12.2 | 8 | | 12.2 | 2.5 | 15.0 | 53.8 | 16.5 |
| 159-fatBF | PHP41103 | AFS 6671.12.2 | 9 | | 11.4 | 2.3 | 14.6 | 56.0 | 15.8 |
| 159-fatBF | PHP41103 | AFS 6671.12.2 | 10 | | 2.7 | 1.7 | 33.5 | 49.7 | 12.4 |
| 159-fatBF | PHP41103 | AFS 6671.12.2 | 11 | | 10.8 | 2.9 | 40.5 | 34.7 | 11.1 |
| 159-fatBF | PHP41103 | AFS 6671.12.2 | 12 | | 2.4 | 1.7 | 30.9 | 50.2 | 14.7 |
| 159-fatBF | PHP41103 | AFS 6671.12.2 | 13 | | 2.4 | 2.4 | 42.6 | 41.7 | 10.9 |
| 159-fatBF | PHP41103 | AFS 6671.12.2 | 14 | | 11.7 | 2.9 | 16.7 | 53.1 | 15.6 |
| 159-fatBF | PHP41103 | AFS 6671.12.2 | 15 | | 2.4 | 1.9 | 18.3 | 64.7 | 12.7 |
| 159-fatBF | PHP41103 | AFS 6671.12.2 | 16 | | 2.2 | 2.1 | 28.4 | 54.7 | 12.6 |
| 159-fatBF | PHP41103 | AFS 6671.12.2 | 17 | | 2.4 | 2.1 | 20.0 | 62.8 | 12.7 |
| 159-fatBF | PHP41103 | AFS 6671.12.2 | 18 | | 11.5 | 2.6 | 26.9 | 46.8 | 12.2 |
| 159-fatBF | PHP41103 | AFS 6671.12.2 | 19 | | 2.6 | 2.4 | 41.6 | 43.2 | 10.2 |
| 159-fatBF | PHP41103 | AFS 6671.12.2 | 20 | | 2.7 | 1.9 | 25.1 | 56.6 | 13.8 |
| 159-fatBF | PHP41103 | AFS 6671.12.2 | 21 | | 2.5 | 1.7 | 23.1 | 59.7 | 12.9 |

TABLE 7g

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6783.2.2 | 1a | | 5.6 | 2.3 | 30.5 | 55.9 | 5.6 |
| 159-fad2-1b/159-fatBf/159-fad3c | PHP41784A | AFS 6783.2.2 | 2a | | 4.3 | 2.2 | 54.3 | 35.9 | 3.4 |
| 159-fad2-1b/159-fatBf/159-fad3c | PHP41784A | AFS 6783.2.2 | 3a | | 12.7 | 2.6 | 20.2 | 55.8 | 8.8 |
| 159-fad2-1b/159-fatBf/159-fad3c | PHP41784A | AFS 6783.2.2 | 4a | | 4.1 | 2.2 | 50.2 | 39.1 | 4.4 |
| 159-fad2-1b/159-fatBf/159-fad3c | PHP41784A | AFS 6783.2.2 | 5a | | 12.4 | 2.9 | 18.2 | 58.7 | 7.8 |
| 159-fad2-1b/159-fatBf/159-fad3c | PHP41784A | AFS 6783.5.1 | 1a | | 11.3 | 3.1 | 28.8 | 51.0 | 5.9 |
| 159-fad2-1b/159-fatBf/159-fad3c | PHP41784A | AFS 6783.5.1 | 2a | | 2.7 | 1.9 | 84.7 | 8.6 | 2.1 |
| 159-fad2-1b/159-fatBf/159-fad3c | PHP41784A | AFS 6783.5.1 | 3a | | 2.6 | 2.0 | 88.1 | 6.1 | 1.2 |
| 159-fad2-1b/159-fatBf/159-fad3c | PHP41784A | AFS 6783.5.1 | 4a | | 2.7 | 2.0 | 84.8 | 8.3 | 2.3 |
| 159-fad2-1b/159-fatBf/159-fad3c | PHP41784A | AFS 6783.5.1 | 5a | | 2.4 | 2.0 | 88.5 | 5.9 | 1.1 |
| 159-fad2-1b/159-fatBf/159-fad3c | PHP41784A | AFS 6783.5.2 | 1a | | 12.2 | 3.3 | 33.7 | 44.3 | 6.5 |
| 159-fad2-1b/159-fatBf/159-fad3c | PHP41784A | AFS 6783.5.2 | 2a | | 2.7 | 2.8 | 86.6 | 6.2 | 1.7 |
| 159-fad2-1b/159-fatBf/159-fad3c | PHP41784A | AFS 6783.5.2 | 3a | | 2.8 | 1.8 | 81.3 | 11.7 | 2.4 |
| 159-fad2-1b/159-fatBf/159-fad3c | PHP41784A | AFS 6783.5.2 | 4a | | 2.2 | 1.6 | 91.2 | 3.6 | 1.4 |
| 159-fad2-1b/159-fatBf/159-fad3c | PHP41784A | AFS 6783.5.2 | 5a | | 4.0 | 2.3 | 79.1 | 12.2 | 2.4 |
| 159-fad2-1b/159-fatBf/159-fad3c | PHP41784A | AFS 6784.4.3 | 1a | | 12.9 | 2.6 | 27.1 | 51.7 | 5.7 |
| 159-fad2-1b/159-fatBf/159-fad3c | PHP41784A | AFS 6784.4.3 | 2a | | 6.8 | 2.3 | 40.3 | 47.6 | 3.0 |
| 159-fad2-1b/159-fatBf/159-fad3c | PHP41784A | AFS 6784.4.3 | 3a | | 4.1 | 2.3 | 48.0 | 42.1 | 3.4 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.4.3 | 4a | | 5.4 | 2.4 | 41.5 | 46.7 | 3.9 |
| 159-fad2-1b/159-fatBf/159-fad3c | PHP41784A | AFS 6784.4.3 | 5a | | 2.3 | 2.1 | 86.9 | 6.7 | 2.0 |
| 159-fad2-1b/159-fatBf/159-fad3c | PHP41784A | AFS 6783.6.1 | 1a | | 2.9 | 1.7 | 89.7 | 4.1 | 1.7 |
| 159-fad2-1b/159-fatBf/159-fad3c | PHP41784A | AFS 6783.6.1 | 2a | | 2.3 | 1.9 | 91.0 | 3.9 | 0.9 |
| 159-fad2-1b/159-fatBf/159-fad3c | PHP41784A | AFS 6783.6.1 | 3a | | 3.5 | 2.1 | 85.8 | 6.6 | 2.0 |
| 159-fad2-1b/159-fatBf/159-fad3c | PHP41784A | AFS 6783.6.1 | 4a | | 2.8 | 1.9 | 89.9 | 4.5 | 1.0 |
| 159-fad2-1b/159-fatBf/159-fad3c | PHP41784A | AFS 6783.6.1 | 5a | | 2.6 | 2.1 | 88.7 | 5.4 | 1.2 |
| 159-fad2-1b/159-fatBf/159-fad3c | PHP41784A | AFS 6783.6.1 | 1 | | 2.1 | 1.8 | 89.3 | 5.2 | 1.5 |
| 159-fad2-1b/159-fatBf/159-fad3c | PHP41784A | AFS 6783.6.1 | 2 | | 0.0 | 0.0 | 94.9 | 5.1 | 0.0 |
| 159-fad2-1b/159-fatBf/159-fad3c | PHP41784A | AFS 6783.6.1 | 3 | | 2.3 | 2.4 | 89.2 | 6.1 | 0.0 |
| 159-fad2-1b/159-fatBf/159-fad3c | PHP41784A | AFS 6783.6.1 | 4 | | 2.2 | 2.3 | 87.1 | 6.7 | 1.8 |
| 159-fad2-1b/159-fatBf/159-fad3c | PHP41784A | AFS 6783.6.1 | 5 | | 1.9 | 1.7 | 92.8 | 3.6 | 0.0 |
| 159-fad2-1b/159-fatBf/159-fad3c | PHP41784A | AFS 6783.6.1 | 6 | | 2.1 | 2.1 | 89.0 | 5.5 | 1.2 |
| 159-fad2-1b/159-fatBf/159-fad3c | PHP41784A | AFS 6783.6.1 | 7 | | 2.0 | 1.9 | 90.7 | 4.1 | 1.3 |
| 159-fad2-1b/159-fatBf/159-fad3c | PHP41784A | AFS 6783.6.1 | 8 | | 2.1 | 2.3 | 88.4 | 5.6 | 1.6 |
| 159-fad2-1b/159-fatBf/159-fad3c | PHP41784A | AFS 6783.6.1 | 9 | | 2.2 | 2.3 | 89.9 | 4.5 | 1.1 |
| 159-fad2-1b/159-fatBf/159-fad3c | PHP41784A | AFS 6783.6.1 | 10 | | 1.9 | 2.3 | 89.3 | 5.2 | 1.3 |
| 159-fad2-1b/159-fatBf/159-fad3c | PHP41784A | AFS 6783.6.1 | 11 | | 14.0 | 3.8 | 1.5 | 67.0 | 13.7 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6783.6.1 | 12 | | 1.8 | 1.7 | 90.8 | 4.6 | 1.1 |
| 159-fad2-1b/159-fatBf/159-fad3c | PHP41784A | AFS 6783.6.1 | 13 | | 1.9 | 1.8 | 88.0 | 6.4 | 1.9 |
| 159-fad2-1b/159-fatBf/159-fad3c | PHP41784A | AFS 6783.6.1 | 14 | | 1.6 | 1.3 | 91.2 | 4.2 | 1.7 |
| 159-fad2-1b/159-fatBf/159-fad3c | PHP41784A | AFS 6783.6.1 | 15 | | 1.8 | 2.0 | 89.6 | 5.0 | 1.5 |
| 159-fad2-1b/159-fatBf/159-fad3c | PHP41784A | AFS 6783.6.1 | 16 | | 2.0 | 1.6 | 90.0 | 4.8 | 1.5 |
| 159-fad2-1b/159-fatBf/159-fad3c | PHP41784A | AFS 6783.6.1 | 17 | | 2.3 | 2.1 | 85.6 | 7.6 | 2.4 |
| 159-fad2-1b/159-fatBf/159-fad3c | PHP41784A | AFS 6783.6.1 | 18 | | 2.2 | 1.9 | 90.4 | 4.4 | 1.0 |
| 159-fad2-1b/159-fatBf/159-fad3c | PHP41784A | AFS 6783.6.1 | 19 | | 1.9 | 1.5 | 92.3 | 4.3 | 0.0 |
| 159-fad2-1b/159-fatBf/159-fad3c | PHP41784A | AFS 6783.6.1 | 20 | | 1.9 | 1.8 | 90.0 | 4.8 | 1.6 |
| 159-fad2-1b/159-fatBf/159-fad3c | PHP41784A | AFS 6783.6.1 | 21 | | 2.0 | 1.7 | 89.4 | 4.9 | 2.1 |
| 159-fad2-1b/159-fatBf/159-fad3c | PHP41784A | AFS 6783.6.1 | 22 | | 1.8 | 1.7 | 87.9 | 6.7 | 2.0 |
| 159-fad2-1b/159-fatBf/159-fad3c | PHP41784A | AFS 6783.6.1 | 23 | | 1.9 | 1.8 | 90.7 | 4.5 | 1.1 |
| 159-fad2-1b/159-fatBf/159-fad3c | PHP41784A | AFS 6783.6.1 | 24 | | 3.1 | 2.2 | 74.8 | 11.1 | 8.8 |
| 159-fad2-1b/159-fatBf/159-fad3c | PHP41784A | AFS 6783.8.1 | 1a | 10GR32-1 | 2.5 | 1.9 | 79.2 | 12.3 | 4.2 |
| 159-fad2-1b/159-fatBf/159-fad3c | PHP41784A | AFS 6783.8.1 | 2a | | 2.8 | 2.2 | 82.5 | 10.1 | 2.4 |
| 159-fad2-1b/159-fatBf/159-fad3c | PHP41784A | AFS 6783.8.1 | 3a | | 2.7 | 2.2 | 82.1 | 10.7 | 2.3 |
| 159-fad2-1b/159-fatBf/159-fad3c | PHP41784A | AFS 6783.8.1 | 4a | | 13.1 | 2.7 | 15.9 | 59.9 | 8.4 |
| 159-fad2-1b/159-fatBf/159-fad3c | PHP41784A | AFS 6783.8.1 | 5a | 10GR32-2 | 2.5 | 1.9 | 78.7 | 12.9 | 4.0 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6783.8.1 | 1 | | 2.5 | 2.3 | 80.6 | 14.6 | 0.0 |
| 159-fad2-1b/159-fatBf/159-fad3c | PHP41784A | AFS 6783.8.1 | 2 | 10GR32-4 | 10.7 | 3.1 | 15.3 | 59.7 | 11.2 |
| 159-fad2-1b/159-fatBf/159-fad3c | PHP41784A | AFS 6783.8.1 | 3 | | 2.6 | 2.2 | 73.4 | 17.6 | 4.1 |
| 159-fad2-1b/159-fatBf/159-fad3c | PHP41784A | AFS 6783.8.1 | 4 | | 2.3 | 2.1 | 85.5 | 7.3 | 2.9 |
| 159-fad2-1b/159-fatBf/159-fad3c | PHP41784A | AFS 6783.8.1 | 5 | | 2.2 | 1.9 | 90.1 | 5.8 | 0.0 |
| 159-fad2-1b/159-fatBf/159-fad3c | PHP41784A | AFS 6783.8.1 | 6 | | 2.5 | 2.1 | 80.1 | 11.7 | 3.5 |
| 159-fad2-1b/159-fatBf/159-fad3c | PHP41784A | AFS 6783.8.1 | 7 | | 2.2 | 2.1 | 83.8 | 8.5 | 3.3 |
| 159-fad2-1b/159-fatBf/159-fad3c | PHP41784A | AFS 6783.8.1 | 8 | | 2.3 | 2.0 | 82.4 | 9.7 | 3.7 |
| 159-fad2-1b/159-fatBf/159-fad3c | PHP41784A | AFS 6783.8.1 | 9 | | 2.6 | 2.1 | 78.8 | 12.1 | 4.4 |
| 159-fad2-1b/159-fatBf/159-fad3c | PHP41784A | AFS 6783.8.1 | 10 | 10GR32-11 | 2.0 | 2.3 | 79.3 | 12.7 | 3.8 |
| 159-fad2-1b/159-fatBf/159-fad3c | PHP41784A | AFS 6783.8.1 | 11 | | 0.0 | 0.0 | 77.4 | 22.6 | 0.0 |
| 159-fad2-1b/159-fatBf/159-fad3c | PHP41784A | AFS 6783.8.1 | 12 | | 11.4 | 3.4 | 14.0 | 59.1 | 12.0 |
| 159-fad2-1b/159-fatBf/159-fad3c | PHP41784A | AFS 6783.8.1 | 13 | | 12.2 | 3.6 | 1.5 | 64.0 | 18.7 |
| 159-fad2-1b/159-fatBf/159-fad3c | PHP41784A | AFS 6783.8.1 | 14 | 10GR32-13 | 10.9 | 3.3 | 14.7 | 58.6 | 12.5 |
| 159-fad2-1b/159-fatBf/159-fad3c | PHP41784A | AFS 6783.8.1 | 15 | | 2.5 | 2.1 | 85.8 | 9.6 | 0.0 |
| 159-fad2-1b/159-fatBf/159-fad3c | PHP41784A | AFS 6783.8.1 | 16 | | 2.2 | 1.9 | 79.8 | 12.3 | 3.9 |
| 159-fad2-1b/159-fatBf/159-fad3c | PHP41784A | AFS 6783.8.1 | 17 | | 13.6 | 3.9 | 1.7 | 65.6 | 15.2 |
| 159-fad2-1b/159-fatBf/159-fad3c | PHP41784A | AFS 6783.8.1 | 18 | 10GR32-16 | 10.8 | 3.1 | 15.8 | 59.7 | 10.7 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6783.8.1 | 19 | | 2.0 | 2.1 | 85.7 | 10.2 | 0.0 |
| 159-fad2-1b/159-fatBf/159-fad3c | PHP41784A | AFS 6783.8.1 | 20 | | 2.4 | 2.1 | 75.5 | 15.9 | 4.2 |
| 159-fad2-1b/159-fatBf/159-fad3c | PHP41784A | AFS 6783.8.1 | 21 | | 12.6 | 3.7 | 1.5 | 69.3 | 13.0 |
| 159-fad2-1b/159-fatBf/159-fad3c | PHP41784A | AFS 6783.8.1 | 22 | | 11.6 | 2.7 | 12.8 | 60.9 | 12.1 |
| 159-fad2-1b/159-fatBf/159-fad3c | PHP41784A | AFS 6783.8.1 | 23 | 10GR32-19 | 2.5 | 2.1 | 71.3 | 19.6 | 4.6 |
| 159-fad2-1b/159-fatBf/159-fad3c | PHP41784A | AFS 6783.8.1 | 24 | | 2.3 | 2.3 | 81.5 | 10.4 | 3.5 |
| 159-fad2-1b/159-fatBf/159-fad3c | PHP41784A | AFS 6783.8.2 | 1a | 10GR32-21 | 2.6 | 2.0 | 88.4 | 5.2 | 1.8 |
| 159-fad2-1b/159-fatBf/159-fad3c | PHP41784A | AFS 6783.8.2 | 2a | | 12.9 | 3.1 | 14.1 | 58.3 | 11.5 |
| 159-fad2-1b/159-fatBf/159-fad3c | PHP41784A | AFS 6783.8.2 | 3a | | 3.1 | 2.3 | 82.4 | 9.5 | 2.7 |
| 159-fad2-1b/159-fatBf/159-fad3c | PHP41784A | AFS 6783.8.2 | 4a | 10GR32-22 | 2.5 | 2.1 | 90.7 | 3.4 | 1.5 |
| 159-fad2-1b/159-fatBf/159-fad3c | PHP41784A | AFS 6783.8.2 | 5a | | 2.6 | 2.0 | 87.5 | 5.7 | 2.1 |
| 159-fad2-1b/159-fatBf/159-fad3c | PHP41784A | AFS 6783.8.2 | 1 | | 12.0 | 3.1 | 21.0 | 55.4 | 8.5 |
| 159-fad2-1b/159-fatBf/159-fad3c | PHP41784A | AFS 6783.8.2 | 2 | 10GR32-24 | 11.7 | 3.5 | 18.2 | 53.7 | 12.9 |
| 159-fad2-1b/159-fatBf/159-fad3c | PHP41784A | AFS 6783.8.2 | 3 | 10GR32-25 | 2.0 | 2.0 | 86.5 | 6.7 | 2.9 |
| 159-fad2-1b/159-fatBf/159-fad3c | PHP41784A | AFS 6783.8.2 | 4 | | 2.4 | 2.3 | 82.3 | 9.5 | 3.5 |
| 159-fad2-1b/159-fatBf/159-fad3c | PHP41784A | AFS 6783.8.2 | 5 | | 14.3 | 3.7 | 1.4 | 66.9 | 13.7 |
| 159-fad2-1b/159-fatBf/159-fad3c | PHP41784A | AFS 6783.8.2 | 6 | | 12.3 | 3.0 | 15.0 | 57.4 | 12.3 |
| 159-fad2-1b/159-fatBf/159-fad3c | PHP41784A | AFS 6783.8.2 | 7 | 10GR32-27 | 2.3 | 2.0 | 87.4 | 5.7 | 2.5 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6783.8.2 | 8 | 10GR32-28 | 2.1 | 2.4 | 88.3 | 5.1 | 2.0 |
| 159-fad2-1b/159-fatBf/159-fad3c | PHP41784A | AFS 6783.8.2 | 9 | | 14.1 | 3.2 | 1.8 | 68.4 | 12.4 |
| 159-fad2-1b/159-fatBf/159-fad3c | PHP41784A | AFS 6783.8.2 | 10 | | 11.0 | 4.2 | 36.5 | 41.4 | 7.0 |
| 159-fad2-1b/159-fatBf/159-fad3c | PHP41784A | AFS 6783.8.2 | 11 | | 4.0 | 2.6 | 73.4 | 15.9 | 4.2 |
| 159-fad2-1b/159-fatBf/159-fad3c | PHP41784A | AFS 6783.8.2 | 12 | | 2.6 | 2.8 | 83.1 | 8.6 | 3.0 |
| 159-fad2-1b/159-fatBf/159-fad3c | PHP41784A | AFS 6783.8.2 | 13 | | 14.6 | 3.8 | 1.7 | 68.3 | 11.6 |
| 159-fad2-1b/159-fatBf/159-fad3c | PHP41784A | AFS 6783.8.2 | 14 | 10GR32-30 | 2.4 | 2.3 | 76.5 | 14.5 | 4.4 |
| 159-fad2-1b/159-fatBf/159-fad3c | PHP41784A | AFS 6783.8.2 | 15 | | 11.2 | 3.7 | 25.3 | 51.3 | 8.6 |
| 159-fad2-1b/159-fatBf/159-fad3c | PHP41784A | AFS 6783.8.2 | 16 | | 2.7 | 2.5 | 82.4 | 8.9 | 3.5 |
| 159-fad2-1b/159-fatBf/159-fad3c | PHP41784A | AFS 6783.8.2 | 17 | 10GR32-33 | 2.1 | 2.5 | 85.8 | 7.1 | 2.5 |
| 159-fad2-1b/159-fatBf/159-fad3c | PHP41784A | AFS 6783.8.2 | 18 | | 11.5 | 3.3 | 20.2 | 55.8 | 9.3 |
| 159-fad2-1b/159-fatBf/159-fad3c | PHP41784A | AFS 6783.8.2 | 19 | 10GR32-35 | 2.6 | 2.4 | 79.7 | 11.8 | 3.5 |
| 159-fad2-1b/159-fatBf/159-fad3c | PHP41784A | AFS 6783.8.2 | 20 | | 2.4 | 2.4 | 81.1 | 10.7 | 3.3 |
| 159-fad2-1b/159-fatBf/159-fad3c | PHP41784A | AFS 6783.8.2 | 21 | 10GR32-37 | 2.2 | 2.1 | 84.4 | 8.3 | 3.1 |
| 159-fad2-1b/159-fatBf/159-fad3c | PHP41784A | AFS 6783.8.2 | 22 | | 2.5 | 2.2 | 86.4 | 6.4 | 2.5 |
| 159-fad2-1b/159-fatBf/159-fad3c | PHP41784A | AFS 6783.8.2 | 23 | | 2.1 | 2.4 | 87.6 | 5.5 | 2.4 |
| 159-fad2-1b/159-fatBf/159-fad3c | PHP41784A | AFS 6783.8.2 | 24 | 10GR32-40 | 11.5 | 3.0 | 16.5 | 57.8 | 11.2 |
| 159-fad2-1b/159-fatBf/159-fad3c | PHP41784A | AFS 6784.1.1 | 1a | | 2.5 | 1.9 | 90.3 | 3.5 | 1.7 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.1.1 | 2a | | 2.4 | 2.2 | 85.9 | 3.2 | 6.3 |
| 159-fad2-1b/159-fatBf/159-fad3c | PHP41784A | AFS 6784.1.1 | 3a | | 2.8 | 1.7 | 89.5 | 4.0 | 2.1 |
| 159-fad2-1b/159-fatBf/159-fad3c | PHP41784A | AFS 6784.1.1 | 4a | 10GR32-41 | 2.3 | 2.0 | 90.1 | 3.6 | 2.0 |
| 159-fad2-1b/159-fatBf/159-fad3c | PHP41784A | AFS 6784.1.1 | 5a | 10GR32-42 | 2.2 | 1.9 | 90.4 | 3.2 | 2.2 |
| 159-fad2-1b/159-fatBf/159-fad3c | PHP41784A | AFS 6784.1.1 | 1 | | 13.3 | 3.5 | 1.5 | 69.8 | 12.0 |
| 159-fad2-1b/159-fatBf/159-fad3c | PHP41784A | AFS 6784.1.1 | 2 | 10GR32-43 | 10.3 | 2.5 | 23.8 | 53.3 | 10.0 |
| 159-fad2-1b/159-fatBf/159-fad3c | PHP41784A | AFS 6784.1.1 | 3 | | 2.1 | 2.1 | 86.1 | 6.4 | 3.3 |
| 159-fad2-1b/159-fatBf/159-fad3c | PHP41784A | AFS 6784.1.1 | 4 | 10GR32-45 | 2.2 | 2.4 | 89.5 | 4.1 | 1.8 |
| 159-fad2-1b/159-fatBf/159-fad3c | PHP41784A | AFS 6784.1.1 | 5 | | 13.5 | 3.3 | 1.6 | 64.2 | 17.3 |
| 159-fad2-1b/159-fatBf/159-fad3c | PHP41784A | AFS 6784.1.1 | 6 | | 2.3 | 1.9 | 87.6 | 3.1 | 5.1 |
| 159-fad2-1b/159-fatBf/159-fad3c | PHP41784A | AFS 6784.1.1 | 7 | 10GR32-46 | 2.1 | 1.7 | 89.8 | 0.8 | 5.7 |
| 159-fad2-1b/159-fatBf/159-fad3c | PHP41784A | AFS 6784.1.1 | 8 | 10GR32-47 | 1.8 | 2.0 | 90.1 | 4.0 | 2.0 |
| 159-fad2-1b/159-fatBf/159-fad3c | PHP41784A | AFS 6784.1.1 | 9 | 10GR32-48 | 2.0 | 2.2 | 89.7 | 3.1 | 2.9 |
| 159-fad2-1b/159-fatBf/159-fad3c | PHP41784A | AFS 6784.1.1 | 10 | | 2.2 | 1.8 | 87.4 | 3.7 | 5.0 |
| 159-fad2-1b/159-fatBf/159-fad3c | PHP41784A | AFS 6784.1.1 | 11 | | 14.3 | 3.2 | 1.8 | 67.6 | 13.2 |
| 159-fad2-1b/159-fatBf/159-fad3c | PHP41784A | AFS 6784.1.1 | 12 | | 2.0 | 1.8 | 90.5 | 3.9 | 1.7 |
| 159-fad2-1b/159-fatBf/159-fad3c | PHP41784A | AFS 6784.1.1 | 13 | | 2.1 | 2.0 | 87.9 | 4.9 | 3.2 |
| 159-fad2-1b/159-fatBf/159-fad3c | PHP41784A | AFS 6784.1.1 | 14 | 10GR32-52 | 1.9 | 2.1 | 89.7 | 3.4 | 2.9 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.1.1 | 15 | | 2.4 | 2.4 | 86.0 | 6.7 | 2.5 |
| 159-fad2-1b/159-fatBf/159-fad3c | PHP41784A | AFS 6784.1.1 | 16 | | 2.0 | 1.7 | 87.9 | 5.2 | 3.3 |
| 159-fad2-1b/159-fatBf/159-fad3c | PHP41784A | AFS 6784.1.1 | 17 | | 10.4 | 2.5 | 33.1 | 47.2 | 6.8 |
| 159-fad2-1b/159-fatBf/159-fad3c | PHP41784A | AFS 6784.1.1 | 18 | | 2.3 | 2.2 | 87.2 | 5.3 | 2.9 |
| 159-fad2-1b/159-fatBf/159-fad3c | PHP41784A | AFS 6784.1.1 | 19 | | 10.2 | 2.8 | 24.2 | 57.0 | 5.8 |
| 159-fad2-1b/159-fatBf/159-fad3c | PHP41784A | AFS 6784.1.1 | 20 | 10GR32-56 | 2.2 | 2.3 | 85.2 | 7.1 | 3.2 |
| 159-fad2-1b/159-fatBf/159-fad3c | PHP41784A | AFS 6784.1.1 | 21 | | 12.8 | 3.7 | 1.7 | 73.3 | 8.5 |
| 159-fad2-1b/159-fatBf/159-fad3c | PHP41784A | AFS 6784.1.1 | 22 | | 2.0 | 1.5 | 91.9 | 2.9 | 1.7 |
| 159-fad2-1b/159-fatBf/159-fad3c | PHP41784A | AFS 6784.1.1 | 23 | 10GR32-59 | 1.9 | 2.2 | 90.8 | 3.5 | 1.5 |
| 159-fad2-1b/159-fatBf/159-fad3c | PHP41784A | AFS 6784.1.1 | 24 | | 2.0 | 1.6 | 92.5 | 2.4 | 1.5 |
| 159-fad2-1b/159-fatBf/159-fad3c | PHP41784A | AFS 6784.2.1 | 1a | | 3.9 | 1.8 | 84.7 | 7.3 | 2.4 |
| 159-fad2-1b/159-fatBf/159-fad3c | PHP41784A | AFS 6784.2.1 | 2a | | 3.9 | 2.1 | 76.0 | 15.6 | 2.4 |
| 159-fad2-1b/159-fatBf/159-fad3c | PHP41784A | AFS 6784.2.1 | 3a | 10GR32-61 | 3.6 | 2.3 | 83.2 | 8.5 | 2.4 |
| 159-fad2-1b/159-fatBf/159-fad3c | PHP41784A | AFS 6784.2.1 | 4a | 10GR32-62 | 12.1 | 2.8 | 18.8 | 58.4 | 8.0 |
| 159-fad2-1b/159-fatBf/159-fad3c | PHP41784A | AFS 6784.2.1 | 5a | | 3.2 | 2.3 | 86.6 | 5.8 | 2.0 |
| 159-fad2-1b/159-fatBf/159-fad3c | PHP41784A | AFS 6784.2.1 | 1 | | 12.2 | 3.4 | 1.5 | 69.5 | 13.4 |
| 159-fad2-1b/159-fatBf/159-fad3c | PHP41784A | AFS 6784.2.1 | 2 | 10GR32-64 | 2.9 | 1.9 | 87.9 | 5.7 | 1.6 |
| 159-fad2-1b/159-fatBf/159-fad3c | PHP41784A | AFS 6784.2.1 | 3 | 10GR32-65 | 2.0 | 2.4 | 88.5 | 5.3 | 1.8 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.2.1 | 4 | 10GR32-66 | 2.9 | 2.2 | 89.3 | 4.3 | 1.3 |
| 159-fad2-1b/159-fatBf/159-fad3c | PHP41784A | AFS 6784.2.1 | 5 | | 15.2 | 3.0 | 2.2 | 65.7 | 13.8 |
| 159-fad2-1b/159-fatBf/159-fad3c | PHP41784A | AFS 6784.2.1 | 6 | 10GR32-67 | 2.2 | 2.3 | 89.4 | 4.9 | 1.2 |
| 159-fad2-1b/159-fatBf/159-fad3c | PHP41784A | AFS 6784.2.1 | 7 | 10GR32-68 | 3.1 | 2.0 | 85.2 | 7.5 | 2.3 |
| 159-fad2-1b/159-fatBf/159-fad3c | PHP41784A | AFS 6784.2.1 | 8 | | 11.0 | 3.0 | 16.6 | 59.8 | 9.6 |
| 159-fad2-1b/159-fatBf/159-fad3c | PHP41784A | AFS 6784.2.1 | 9 | | 5.7 | 2.4 | 83.6 | 6.2 | 2.1 |
| 159-fad2-1b/159-fatBf/159-fad3c | PHP41784A | AFS 6784.2.1 | 10 | | 11.5 | 2.8 | 15.9 | 58.0 | 11.8 |
| 159-fad2-1b/159-fatBf/159-fad3c | PHP41784A | AFS 6784.2.1 | 11 | | 6.1 | 2.9 | 84.0 | 5.7 | 1.4 |
| 159-fad2-1b/159-fatBf/159-fad3c | PHP41784A | AFS 6784.2.1 | 12 | 10GR32-71 | 11.7 | 2.6 | 21.7 | 54.7 | 9.3 |
| 159-fad2-1b/159-fatBf/159-fad3c | PHP41784A | AFS 6784.2.1 | 13 | 10GR32-72 | 2.8 | 2.0 | 86.1 | 6.6 | 2.4 |
| 159-fad2-1b/159-fatBf/159-fad3c | PHP41784A | AFS 6784.2.1 | 14 | 10GR32-73 | 3.4 | 1.9 | 83.6 | 8.4 | 2.6 |
| 159-fad2-1b/159-fatBf/159-fad3c | PHP41784A | AFS 6784.2.1 | 15 | | 2.1 | 2.1 | 88.3 | 5.4 | 2.1 |
| 159-fad2-1b/159-fatBf/159-fad3c | PHP41784A | AFS 6784.2.1 | 16 | 10GR32-75 | 2.2 | 2.1 | 91.4 | 3.1 | 1.2 |
| 159-fad2-1b/159-fatBf/159-fad3c | PHP41784A | AFS 6784.2.1 | 17 | | 19.0 | 3.0 | 3.4 | 63.1 | 11.5 |
| 159-fad2-1b/159-fatBf/159-fad3c | PHP41784A | AFS 6784.2.1 | 18 | 10GR32-76 | 3.3 | 2.2 | 86.3 | 6.1 | 2.1 |
| 159-fad2-1b/159-fatBf/159-fad3c | PHP41784A | AFS 6784.2.1 | 19 | 10GR32-77 | 3.0 | 2.2 | 88.9 | 4.5 | 1.3 |
| 159-fad2-1b/159-fatBf/159-fad3c | PHP41784A | AFS 6784.2.1 | 20 | 10GR32-78 | 2.7 | 1.9 | 88.2 | 5.4 | 1.8 |
| 159-fad2-1b/159-fatBf/159-fad3c | PHP41784A | AFS 6784.2.1 | 21 | | 2.8 | 2.3 | 88.0 | 5.0 | 1.9 |

TABLE 7g-continued

Fatty acid profile for T1 seed analyzed from soy transformed with PHP41784, containing the 159-fad2-1b & 159-fatBF & 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.2.1 | 22 | | 2.8 | 2.1 | 85.1 | 7.5 | 2.5 |
| 159-fad2-1b/159-fatBf/159-fad3c | PHP41784A | AFS 6784.2.1 | 23 | | 5.7 | 2.1 | 84.7 | 5.6 | 1.9 |
| 159-fad2-1b/159-fatBf/159-fad3c | PHP41784A | AFS 6784.2.1 | 24 | | 5.7 | 2.0 | 82.7 | 7.1 | 2.6 |
| 159-fad2-1b/159-fatBf/159-fad3c | PHP41784A | AFS 6784.3.2 | 1a | | 3.3 | 2.0 | 78.1 | 14.3 | 2.2 |
| 159-fad2-1b/159-fatBf/159-fad3c | PHP41784A | AFS 6784.3.2 | 2a | | 2.3 | 2.0 | 87.0 | 6.1 | 2.6 |
| 159-fad2-1b/159-fatBf/159-fad3c | PHP41784A | AFS 6784.3.2 | 3a | | 2.9 | 2.4 | 88.2 | 4.9 | 1.6 |
| 159-fad2-1b/159-fatBf/159-fad3c | PHP41784A | AFS 6784.3.2 | 4a | | 12.2 | 3.1 | 15.8 | 59.8 | 9.2 |
| 159-fad2-1b/159-fatBf/159-fad3c | PHP41784A | AFS 6784.3.2 | 5a | | 2.3 | 2.3 | 87.4 | 5.4 | 2.7 |
| 159-fad2-1b/159-fatBf/159-fad3c | PHP41784A | AFS 6784.3.2 | 1 | 10GR32-82 | 12.0 | 2.8 | 13.6 | 60.4 | 11.3 |
| 159-fad2-1b/159-fatBf/159-fad3c | PHP41784A | AFS 6784.3.2 | 2 | | 2.1 | 2.5 | 87.8 | 4.4 | 3.2 |
| 159-fad2-1b/159-fatBf/159-fad3c | PHP41784A | AFS 6784.3.2 | 3 | 10GR32-84 | 12.1 | 3.3 | 1.5 | 67.5 | 15.6 |
| 159-fad2-1b/159-fatBf/159-fad3c | PHP41784A | AFS 6784.3.2 | 4 | | 2.4 | 2.4 | 84.2 | 7.9 | 3.1 |
| 159-fad2-1b/159-fatBf/159-fad3c | PHP41784A | AFS 6784.3.2 | 5 | | 2.0 | 2.1 | 87.2 | 5.1 | 3.6 |
| 159-fad2-1b/159-fatBf/159-fad3c | PHP41784A | AFS 6784.3.2 | 6 | | 2.5 | 2.5 | 88.8 | 4.3 | 1.8 |
| 159-fad2-1b/159-fatBf/159-fad3c | PHP41784A | AFS 6784.3.2 | 7 | | 2.0 | 1.9 | 86.2 | 6.1 | 3.8 |
| 159-fad2-1b/159-fatBf/159-fad3c | PHP41784A | AFS 6784.3.2 | 8 | 10GR32-87 | 2.3 | 2.3 | 84.7 | 7.6 | 3.1 |
| 159-fad2-1b/159-fatBf/159-fad3c | PHP41784A | AFS 6784.3.2 | 9 | | 1.9 | 2.2 | 87.9 | 4.7 | 3.2 |
| 159-fad2-1b/159-fatBf/159-fad3c | PHP41784A | AFS 6784.3.2 | 10 | | 10.7 | 2.7 | 18.9 | 57.8 | 9.8 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.3.2 | 11 | | 2.3 | 2.2 | 87.1 | 5.0 | 3.5 |
| 159-fad2-1b/159-fatBf/159-fad3c | PHP41784A | AFS 6784.3.2 | 12 | | 2.3 | 2.4 | 87.1 | 5.2 | 3.0 |
| 159-fad2-1b/159-fatBf/159-fad3c | PHP41784A | AFS 6784.3.2 | 13 | | 2.7 | 2.4 | 76.2 | 13.8 | 4.9 |
| 159-fad2-1b/159-fatBf/159-fad3c | PHP41784A | AFS 6784.3.2 | 14 | 10GR32-91 | 2.0 | 2.3 | 88.1 | 4.7 | 2.9 |
| 159-fad2-1b/159-fatBf/159-fad3c | PHP41784A | AFS 6784.3.2 | 15 | | 2.0 | 2.3 | 88.8 | 4.0 | 2.9 |
| 159-fad2-1b/159-fatBf/159-fad3c | PHP41784A | AFS 6784.3.2 | 16 | 10GR32-93 | 1.9 | 2.0 | 89.3 | 4.3 | 2.4 |
| 159-fad2-1b/159-fatBf/159-fad3c | PHP41784A | AFS 6784.3.2 | 17 | | 2.0 | 2.2 | 88.5 | 4.3 | 3.0 |
| 159-fad2-1b/159-fatBf/159-fad3c | PHP41784A | AFS 6784.3.2 | 18 | | 2.1 | 2.0 | 87.3 | 5.4 | 3.2 |
| 159-fad2-1b/159-fatBf/159-fad3c | PHP41784A | AFS 6784.3.2 | 19 | 10GR32-96 | 1.9 | 2.4 | 89.6 | 4.0 | 2.1 |
| 159-fad2-1b/159-fatBf/159-fad3c | PHP41784A | AFS 6784.3.2 | 20 | | 2.2 | 2.2 | 86.5 | 5.8 | 3.4 |
| 159-fad2-1b/159-fatBf/159-fad3c | PHP41784A | AFS 6784.3.2 | 21 | | 2.2 | 1.8 | 80.9 | 11.1 | 4.1 |
| 159-fad2-1b/159-fatBf/159-fad3c | PHP41784A | AFS 6784.3.2 | 22 | 10GR32-99 | 2.3 | 2.2 | 88.6 | 4.5 | 2.3 |
| 159-fad2-1b/159-fatBf/159-fad3c | PHP41784A | AFS 6784.3.2 | 23 | | 2.0 | 1.8 | 80.0 | 7.3 | 8.9 |
| 159-fad2-1b/159-fatBf/159-fad3c | PHP41784A | AFS 6784.3.2 | 24 | | 2.3 | 2.0 | 84.3 | 9.3 | 2.0 |
| 159-fad2-1b/159-fatBf/159-fad3c | PHP41784A | AFS 6784.4.2 | 1a | | 13.0 | 2.7 | 19.4 | 56.0 | 9.0 |
| 159-fad2-1b/159-fatBf/159-fad3c | PHP41784A | AFS 6784.4.2 | 2a | | 11.6 | 2.8 | 19.4 | 58.7 | 7.6 |
| 159-fad2-1b/159-fatBf/159-fad3c | PHP41784A | AFS 6784.4.2 | 3a | | 10.5 | 3.4 | 24.1 | 52.8 | 9.2 |
| 159-fad2-1b/159-fatBf/159-fad3c | PHP41784A | AFS 6784.4.2 | 4a | | 2.3 | 2.4 | 85.1 | 8.0 | 2.2 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.4.2 | 5a | | 3.0 | 2.0 | 76.9 | 15.8 | 2.4 |
| 159-fad2-1b/159-fatBf/159-fad3c | PHP41784A | AFS 6784.4.2 | 1 | | 1.9 | 2.3 | 86.3 | 6.8 | 2.8 |
| 159-fad2-1b/159-fatBf/159-fad3c | PHP41784A | AFS 6784.4.2 | 2 | | 2.2 | 2.0 | 87.0 | 6.4 | 2.4 |
| 159-fad2-1b/159-fatBf/159-fad3c | PHP41784A | AFS 6784.4.2 | 3 | | 13.6 | 3.6 | 1.4 | 67.2 | 14.2 |
| 159-fad2-1b/159-fatBf/159-fad3c | PHP41784A | AFS 6784.4.2 | 4 | | 10.3 | 3.1 | 11.5 | 62.1 | 13.0 |
| 159-fad2-1b/159-fatBf/159-fad3c | PHP41784A | AFS 6784.4.2 | 5 | | 10.1 | 2.9 | 18.0 | 59.0 | 10.0 |
| 159-fad2-1b/159-fatBf/159-fad3c | PHP41784A | AFS 6784.4.2 | 6 | | 15.2 | 4.3 | 19.9 | 53.3 | 7.3 |
| 159-fad2-1b/159-fatBf/159-fad3c | PHP41784A | AFS 6784.4.2 | 7 | | 2.1 | 2.7 | 80.5 | 10.9 | 3.7 |
| 159-fad2-1b/159-fatBf/159-fad3c | PHP41784A | AFS 6784.4.2 | 8 | | 2.4 | 2.2 | 80.7 | 10.7 | 3.9 |
| 159-fad2-1b/159-fatBf/159-fad3c | PHP41784A | AFS 6784.4.2 | 9 | | 2.7 | 2.1 | 81.0 | 11.7 | 2.6 |
| 159-fad2-1b/159-fatBf/159-fad3c | PHP41784A | AFS 6784.4.2 | 10 | | 10.5 | 2.9 | 19.5 | 59.2 | 7.9 |
| 159-fad2-1b/159-fatBf/159-fad3c | PHP41784A | AFS 6784.4.2 | 11 | | 13.5 | 3.2 | 1.5 | 70.8 | 10.9 |
| 159-fad2-1b/159-fatBf/159-fad3c | PHP41784A | AFS 6784.4.2 | 12 | | 11.5 | 3.2 | 13.5 | 60.9 | 10.9 |
| 159-fad2-1b/159-fatBf/159-fad3c | PHP41784A | AFS 6784.4.2 | 13 | | 2.5 | 2.1 | 82.6 | 9.6 | 3.3 |
| 159-fad2-1b/159-fatBf/159-fad3c | PHP41784A | AFS 6784.4.2 | 14 | | 2.6 | 2.3 | 78.4 | 12.8 | 3.9 |
| 159-fad2-1b/159-fatBf/159-fad3c | PHP41784A | AFS 6784.4.2 | 15 | | 3.4 | 2.1 | 67.0 | 22.8 | 4.7 |
| 159-fad2-1b/159-fatBf/159-fad3c | PHP41784A | AFS 6784.4.2 | 16 | | 10.0 | 3.0 | 23.9 | 54.9 | 8.2 |

TABLE 7g-continued

Fatty acid profile for T1 seed analyzed from soy transformed with PHP41784, containing the 159-fad2-1b & 159-fatBF& 159-fad3c amiRNAs, grown in the greenhouse.

| amiRNA | Construct | Event | Seed No. | T1 Seed Planted | 16:0 | 18:0 | 18:1 | 18:2 | 18:3 |
|---|---|---|---|---|---|---|---|---|---|
| 159-fad2-1b/159-fatBf/159-fad3c | PHP41784A | AFS 6784.4.2 | 17 | | 10.7 | 2.9 | 18.3 | 58.7 | 9.4 |
| 159-fad2-1b/159-fatBf/159-fad3c | PHP41784A | AFS 6784.4.2 | 18 | | 3.2 | 2.0 | 59.5 | 30.2 | 5.2 |
| 159-fad2-1b/159-fatBf/159-fad3c | PHP41784A | AFS 6784.4.2 | 19 | | 2.2 | 2.7 | 84.0 | 8.4 | 2.7 |
| 159-fad2-1b/159-fatBf/159-fad3c | PHP41784A | AFS 6784.4.2 | 20 | | 9.7 | 2.5 | 25.7 | 53.9 | 8.1 |
| 159-fad2-1b/159-fatBf/159-fad3c | PHP41784A | AFS 6784.4.2 | 21 | | 3.2 | 2.2 | 74.3 | 16.5 | 3.9 |
| 159-fad2-1b/159-fatBf/159-fad3c | PHP41784A | AFS 6784.4.2 | 22 | | 10.1 | 3.2 | 15.2 | 61.1 | 10.4 |
| 159-fad2-1b/159-fatBf/159-fad3c | PHP41784A | AFS 6784.4.2 | 23 | | 2.8 | 2.0 | 72.7 | 18.6 | 3.9 |
| 159-fad2-1b/159-fatBf/159-fad3c | PHP41784A | AFS 6784.4.2 | 24 | | 2.5 | 2.0 | 84.5 | 8.7 | 2.2 |

Analysis of Fatty Acid Profiles of T2 Seed from Events Expressing amiRNAs Grown in the Greenhouse T1 seed from events having phenotypes indicating functional amiRNAs were planted and plants grown in the greenhouse.

T1 seed planted from soy transformed with PHP32510, containing the 369b-fad2-1b amiRNA or PHP32511, containing the 159-fad2-1b amiRNA, or PHP32843, containing the 369b-fad2-1b & 159-fad2-2 amiRNAs were given an 8GR31 experiment designation.

T1 seed planted from soy transformed with PHP33705, containing the 396-fad2-1b & 396b-sad3 amiRNAs, or PHP38557, containing the 159-fad3c amiRNA, or PHP41103, containing the 159-fatBF amiRNA, were given a 10GR13 experiment designation.

T1 seed planted from soy transformed with PHP41784, containing the 159-fad2-1b & 159-fatBF& 159-fad3c amiRNAs, were given a 10GR32 experiment designation.

T2 seed from each experiment were harvested and approximately 5 to 10 seed from each T2 seed pack for each event where the T1 seed indicated a positive phenotype, were chipped and fatty acids analyzed by GC/FAME as described inter alia.

Those seed packs where T1 seed indicated a negative phenotype (null segregant seed), were also analyzed but in that case, fewer than 5-10 T2 seed were sometimes analyzed.

The fatty acid profile for T2 seed analyzed from soy transformed with PHP32510, containing the 369b-fad2-1b amiRNA or PHP32511, containing the 159-fad2-1b amiRNA is shown in Table 8.

The fatty acid profile for T2 seed analyzed from soy transformed with PHP32843, containing the 369b-fad2-1b & 159-fad2-2 amiRNAs is shown in Table 9.

The fatty acid profile for T2 seed analyzed from soy transformed with PHP33705, containing the 396-fad2-1b & 396b-sad3 amiRNAs is shown in Table 10.

The fatty acid profile for T2 seed analyzed from soy transformed with PHP38557, containing the 159-fad3c amiRNA, is shown in Table 11.

The fatty acid profile for T2 seed analyzed from soy transformed with PHP41103, containing the 159-fatBF amiRNA, is shown in Table 12.

The fatty acid profile for T2 seed analyzed from soy transformed with PHP41784, containing the 159-fad2-1b & 159-fatBF& 159-fad3c amiRNAs is shown in Table 13.

In Table 8-13, the name of the amiRNA in the construct, as well as the construct name itself is indicated. Also shown is the event name for the T2 seed packs that were chosen for analysis. Each T1 seed planted was also given an experiment name (e.g. 8GR31-1) which was kept for each T2 seed pack harvested. Data shown in Table 8-13 is from those seed packs where seed fatty acid profiles indicated the seed pack was from a homozygous plant (i.e. no null segregants) as well some which were all wild-type-like (null), where Homoz Pos indicates a homozygous seed pack, and Null indicates a null segregant pack from that event.

TABLE 8

Fatty acid profile for T2 seed analyzed from soy transformed with PHP32510, containing the 369b-fad2-1b amiRNA or PHP32511, containing the 159-fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b | PHP32510 | AFS 5260.3.3 | 8GR31-16 | 1 | 11.9 | 3.1 | 26.6 | 53.6 | 4.7 | Null |
| 396b-fad2-1b | PHP32510 | AFS 5260.3.3 | 8GR31-16 | 2 | 12.1 | 3.3 | 11.0 | 62.3 | 11.2 | Null |
| 396b-fad2-1b | PHP32510 | AFS 5260.3.3 | 8GR31-16 | 3 | 11.4 | 3.2 | 15.0 | 62.9 | 7.5 | Null |
| 396b-fad2-1b | PHP32510 | AFS 5260.3.3 | 8GR31-16 | 4 | 12.7 | 3.8 | 12.5 | 60.7 | 10.2 | Null |
| 396b-fad2-1b | PHP32510 | AFS 5260.3.3 | 8GR31-16 | 5 | 11.2 | 3.0 | 17.8 | 61.5 | 6.5 | Null |
| 396b-fad2-1b | PHP32510 | AFS 5260.3.11 | 8GR31-7 | 1 | 14.6 | 3.5 | 13.7 | 60.9 | 7.2 | Null |
| 396b-fad2-1b | PHP32510 | AFS 5260.3.11 | 8GR31-7 | 2 | 14.0 | 3.8 | 7.7 | 62.5 | 12.0 | Null |
| 396b-fad2-1b | PHP32510 | AFS 5260.3.11 | 8GR31-7 | 3 | 14.1 | 3.4 | 35.3 | 42.9 | 4.4 | Null |
| 396b-fad2-1b | PHP32510 | AFS 5260.3.11 | 8GR31-7 | 4 | 13.5 | 3.7 | 21.6 | 55.2 | 6.0 | Null |
| 396b-fad2-1b | PHP32510 | AFS 5260.3.11 | 8GR31-7 | 5 | 13.6 | 3.2 | 16.4 | 60.0 | 6.8 | Null |
| 396b-fad2-1b | PHP32510 | AFS 5260.2.3 | 8GR31-2 | 1 | 9.0 | 3.8 | 78.6 | 4.7 | 3.9 | Homoz Pos |
| 396b-fad2-1b | PHP32510 | AFS 5260.2.3 | 8GR31-2 | 2 | 8.1 | 3.5 | 83.6 | 1.6 | 3.2 | Homoz Pos |
| 396b-fad2-1b | PHP32510 | AFS 5260.2.3 | 8GR31-2 | 3 | 8.0 | 3.3 | 83.5 | 1.6 | 3.6 | Homoz Pos |
| 396b-fad2-1b | PHP32510 | AFS 5260.2.3 | 8GR31-2 | 4 | 8.2 | 3.5 | 83.1 | 1.6 | 3.5 | Homoz Pos |
| 396b-fad2-1b | PHP32510 | AFS 5260.2.3 | 8GR31-2 | 5 | 7.5 | 3.5 | 84.4 | 1.5 | 3.2 | Homoz Pos |
| 396b-fad2-1b | PHP32510 | AFS 5260.2.3 | 8GR31-2 | 6 | 7.8 | 3.0 | 84.3 | 1.4 | 3.6 | Homoz Pos |
| 396b-fad2-1b | PHP32510 | AFS 5260.2.3 | 8GR31-2 | 7 | 8.0 | 2.8 | 83.7 | 1.7 | 3.8 | Homoz Pos |
| 396b-fad2-1b | PHP32510 | AFS 5260.2.3 | 8GR31-2 | 8 | 7.7 | 3.0 | 84.5 | 1.5 | 3.3 | Homoz Pos |
| 396b-fad2-1b | PHP32510 | AFS 5260.2.3 | 8GR31-2 | 9 | 7.3 | 3.2 | 85.0 | 1.2 | 3.3 | Homoz Pos |
| 396b-fad2-1b | PHP32510 | AFS 5260.2.3 | 8GR31-2 | 10 | 8.0 | 2.9 | 84.3 | 1.4 | 3.4 | Homoz Pos |
| 396b-fad2-1b | PHP32510 | AFS 5260.2.3 | 8GR31-3 | 1 | 7.6 | 3.5 | 84.2 | 1.4 | 3.2 | Homoz Pos |
| 396b-fad2-1b | PHP32510 | AFS 5260.2.3 | 8GR31-3 | 2 | 8.1 | 3.2 | 84.0 | 1.3 | 3.3 | Homoz Pos |
| 396b-fad2-1b | PHP32510 | AFS 5260.2.3 | 8GR31-3 | 3 | 8.0 | 3.3 | 83.8 | 1.4 | 3.5 | Homoz Pos |
| 396b-fad2-1b | PHP32510 | AFS 5260.2.3 | 8GR31-3 | 4 | 8.0 | 3.3 | 83.2 | 1.5 | 4.0 | Homoz Pos |

TABLE 8-continued

Fatty acid profile for T2 seed analyzed from soy transformed with PHP32510, containing the 369b-fad2-1b amiRNA or PHP32511, containing the 159-fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b | PHP32510 | AFS 5260.2.3 | 8GR31-3 | 5 | 7.6 | 3.5 | 84.1 | 1.3 | 3.5 | Homoz Pos |
| 396b-fad2-1b | PHP32510 | AFS 5260.3.6 | 8GR31-19 | 1 | 7.9 | 3.4 | 83.8 | 1.3 | 3.7 | Homoz Pos |
| 396b-fad2-1b | PHP32510 | AFS 5260.3.6 | 8GR31-19 | 2 | 7.5 | 3.7 | 83.9 | 1.4 | 3.5 | Homoz Pos |
| 396b-fad2-1b | PHP32510 | AFS 5260.3.6 | 8GR31-19 | 3 | 7.5 | 4.0 | 84.2 | 1.2 | 3.2 | Homoz Pos |
| 396b-fad2-1b | PHP32510 | AFS 5260.3.6 | 8GR31-19 | 4 | 7.3 | 3.9 | 84.6 | 1.4 | 2.9 | Homoz Pos |
| 396b-fad2-1b | PHP32510 | AFS 5260.3.6 | 8GR31-19 | 5 | 7.5 | 3.1 | 84.9 | 1.3 | 3.2 | Homoz Pos |
| 396b-fad2-1b | PHP32510 | AFS 5260.3.6 | 8GR31-19 | 6 | 8.1 | 3.2 | 83.3 | 1.5 | 3.8 | Homoz Pos |
| 396b-fad2-1b | PHP32510 | AFS 5260.3.6 | 8GR31-19 | 7 | 8.0 | 3.6 | 80.2 | 3.3 | 4.8 | Homoz Pos |
| 396b-fad2-1b | PHP32510 | AFS 5260.3.6 | 8GR31-19 | 8 | 7.8 | 3.2 | 83.7 | 1.5 | 3.7 | Homoz Pos |
| 396b-fad2-1b | PHP32510 | AFS 5260.3.6 | 8GR31-19 | 9 | 6.9 | 4.1 | 84.8 | 1.3 | 3.0 | Homoz Pos |
| 396b-fad2-1b | PHP32510 | AFS 5260.3.6 | 8GR31-19 | 10 | 7.7 | 3.3 | 84.0 | 1.3 | 3.7 | Homoz Pos |
| 396b-fad2-1b | PHP32510 | AFS 5260.4.5 | 8GR31-24 | 1 | 7.6 | 3.3 | 85.2 | 1.2 | 2.7 | Homoz Pos |
| 396b-fad2-1b | PHP32510 | AFS 5260.4.5 | 8GR31-24 | 2 | 8.6 | 3.0 | 84.5 | 1.0 | 2.9 | Homoz Pos |
| 396b-fad2-1b | PHP32510 | AFS 5260.4.5 | 8GR31-24 | 3 | 8.3 | 3.3 | 83.4 | 1.2 | 3.9 | Homoz Pos |
| 396b-fad2-1b | PHP32510 | AFS 5260.4.5 | 8GR31-24 | 4 | 7.8 | 3.5 | 83.8 | 1.3 | 3.5 | Homoz Pos |
| 396b-fad2-1b | PHP32510 | AFS 5260.4.5 | 8GR31-24 | 5 | 8.0 | 3.4 | 84.9 | 1.2 | 2.5 | Homoz Pos |
| 396b-fad2-1b | PHP32510 | AFS 5260.4.5 | 8GR31-25 | 1 | 7.9 | 3.1 | 84.7 | 1.1 | 3.2 | Homoz Pos |
| 396b-fad2-1b | PHP32510 | AFS 5260.4.5 | 8GR31-25 | 2 | 8.4 | 3.2 | 84.0 | 1.3 | 3.2 | Homoz Pos |
| 396b-fad2-1b | PHP32510 | AFS 5260.4.5 | 8GR31-25 | 3 | 7.7 | 3.6 | 84.0 | 1.2 | 3.5 | Homoz Pos |
| 396b-fad2-1b | PHP32510 | AFS 5260.4.5 | 8GR31-25 | 4 | 8.2 | 3.4 | 84.2 | 1.0 | 3.3 | Homoz Pos |
| 396b-fad2-1b | PHP32510 | AFS 5260.4.5 | 8GR31-25 | 5 | 7.8 | 3.2 | 84.9 | 1.1 | 2.9 | Homoz Pos |
| 396b-fad2-1b | PHP32510 | AFS 5260.4.5 | 8GR31-25 | 6 | 7.9 | 3.1 | 85.2 | 1.2 | 2.7 | Homoz Pos |
| 396b-fad2-1b | PHP32510 | AFS 5260.4.5 | 8GR31-25 | 7 | 8.2 | 2.9 | 85.1 | 1.0 | 2.8 | Homoz Pos |
| 396b-fad2-1b | PHP32510 | AFS 5260.4.5 | 8GR31-25 | 8 | 7.7 | 2.9 | 85.7 | 1.0 | 2.6 | Homoz Pos |

TABLE 8-continued

Fatty acid profile for T2 seed analyzed from soy transformed with
PHP32510, containing the 369b-fad2-1b amiRNA or PHP32511, containing the 159-
fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b | PHP32510 | AFS 5260.4.5 | 8GR31-25 | 9 | 7.3 | 3.1 | 85.8 | 0.9 | 2.8 | Homoz Pos |
| 396b-fad2-1b | PHP32510 | AFS 5260.4.5 | 8GR31-25 | 10 | 7.6 | 3.4 | 84.4 | 1.2 | 3.4 | Homoz Pos |
| 159-fad2-1b | PHP32511 | AFS 5292.1.4 | 8GR31-58 | 1 | 8.3 | 3.1 | 83.3 | 1.4 | 3.9 | Homoz Pos |
| 159-fad2-1b | PHP32511 | AFS 5292.1.4 | 8GR31-58 | 2 | 8.0 | 3.5 | 82.6 | 1.7 | 4.3 | Homoz Pos |
| 159-fad2-1b | PHP32511 | AFS 5292.1.4 | 8GR31-58 | 3 | 7.5 | 4.0 | 82.1 | 1.7 | 4.6 | Homoz Pos |
| 159-fad2-1b | PHP32511 | AFS 5292.1.4 | 8GR31-58 | 4 | 7.4 | 3.5 | 84.1 | 1.4 | 3.5 | Homoz Pos |
| 159-fad2-1b | PHP32511 | AFS 5292.1.4 | 8GR31-58 | 5 | 8.1 | 3.3 | 83.7 | 1.6 | 3.4 | Homoz Pos |
| 159-fad2-1b | PHP32511 | AFS 5292.1.4 | 8GR31-59 | 1 | 7.9 | 3.5 | 84.2 | 1.5 | 2.9 | Homoz Pos |
| 159-fad2-1b | PHP32511 | AFS 5292.1.4 | 8GR31-59 | 2 | 7.8 | 3.3 | 84.0 | 1.5 | 3.4 | Homoz Pos |
| 159-fad2-1b | PHP32511 | AFS 5292.1.4 | 8GR31-59 | 3 | 8.5 | 3.9 | 81.6 | 1.9 | 4.0 | Homoz Pos |
| 159-fad2-1b | PHP32511 | AFS 5292.1.4 | 8GR31-59 | 4 | 7.8 | 3.2 | 84.6 | 1.5 | 2.9 | Homoz Pos |
| 159-fad2-1b | PHP32511 | AFS 5292.1.4 | 8GR31-59 | 5 | | | | | | Homoz Pos |
| 159-fad2-1b | PHP32511 | AFS 5292.1.4 | 8GR31-59 | 6 | 8.2 | 3.2 | 81.3 | 3.4 | 4.0 | Homoz Pos |
| 159-fad2-1b | PHP32511 | AFS 5292.1.4 | 8GR31-59 | 7 | 8.1 | 3.0 | 84.3 | 1.6 | 3.1 | Homoz Pos |
| 159-fad2-1b | PHP32511 | AFS 5292.1.4 | 8GR31-59 | 8 | 8.0 | 3.3 | 82.5 | 1.8 | 4.4 | Homoz Pos |
| 159-fad2-1b | PHP32511 | AFS 5292.1.4 | 8GR31-59 | 9 | 8.2 | 3.2 | 83.9 | 1.3 | 3.5 | Homoz Pos |
| 159-fad2-1b | PHP32511 | AFS 5292.1.4 | 8GR31-59 | 10 | 8.0 | 3.2 | 82.4 | 2.8 | 3.7 | Homoz Pos |
| 159-fad2-1b | PHP32511 | AFS 5292.1.4 | 8GR31-61 | 1 | 7.7 | 3.6 | 82.6 | 2.0 | 4.1 | Homoz Pos |
| 159-fad2-1b | PHP32511 | AFS 5292.1.4 | 8GR31-61 | 2 | 7.8 | 3.3 | 83.9 | 1.6 | 3.4 | Homoz Pos |
| 159-fad2-1b | PHP32511 | AFS 5292.1.4 | 8GR31-61 | 3 | 7.8 | 3.6 | 83.0 | 1.7 | 3.7 | Homoz Pos |
| 159-fad2-1b | PHP32511 | AFS 5292.1.4 | 8GR31-61 | 4 | 8.1 | 3.4 | 83.1 | 1.7 | 3.7 | Homoz Pos |
| 159-fad2-1b | PHP32511 | AFS 5292.1.4 | 8GR31-61 | 5 | 7.7 | 3.7 | 83.6 | 1.6 | 3.5 | Homoz Pos |
| 159-fad2-1b | PHP32511 | AFS 5292.5.8 | 8GR31-38 | 1 | 7.5 | 3.5 | 84.7 | 1.3 | 3.1 | Homoz Pos |
| 159-fad2-1b | PHP32511 | AFS 5292.5.8 | 8GR31-38 | 2 | 7.8 | 3.6 | 83.9 | 1.2 | 3.4 | Homoz Pos |

TABLE 8-continued

Fatty acid profile for T2 seed analyzed from soy transformed with
PHP32510, containing the 369b-fad2-1b amiRNA or PHP32511, containing the 159-
fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b | PHP32511 | AFS 5292.5.8 | 8GR31-38 | 3 | 8.1 | 3.1 | 84.9 | 1.3 | 2.7 | Homoz Pos |
| 159-fad2-1b | PHP32511 | AFS 5292.5.8 | 8GR31-38 | 4 | 8.4 | 3.8 | 83.4 | 1.5 | 2.9 | Homoz Pos |
| 159-fad2-1b | PHP32511 | AFS 5292.5.8 | 8GR31-38 | 5 | 8.4 | 3.1 | 83.7 | 1.1 | 3.7 | Homoz Pos |
| 159-fad2-1b | PHP32511 | AFS 5292.5.8 | 8GR31-38 | 6 | 8.0 | 3.1 | 84.3 | 1.2 | 3.4 | Homoz Pos |
| 159-fad2-1b | PHP32511 | AFS 5292.5.8 | 8GR31-38 | 7 | 8.4 | 3.3 | 83.8 | 1.4 | 3.0 | Homoz Pos |
| 159-fad2-1b | PHP32511 | AFS 5292.5.8 | 8GR31-38 | 8 | 8.3 | 3.1 | 84.0 | 1.1 | 3.4 | Homoz Pos |
| 159-fad2-1b | PHP32511 | AFS 5292.5.8 | 8GR31-38 | 9 | 8.7 | 2.7 | 85.3 | 1.4 | 2.0 | Homoz Pos |
| 159-fad2-1b | PHP32511 | AFS 5292.5.8 | 8GR31-38 | 10 | 7.9 | 3.1 | 84.5 | 1.2 | 3.3 | Homoz Pos |
| 159-fad2-1b | PHP32511 | AFS 5292.6.5 | 8GR31-67 | 1 | 9.4 | 3.3 | 82.5 | 1.3 | 3.5 | Homoz Pos |
| 159-fad2-1b | PHP32511 | AFS 5292.6.5 | 8GR31-67 | 2 | 9.1 | 3.1 | 82.9 | 1.2 | 3.7 | Homoz Pos |
| 159-fad2-1b | PHP32511 | AFS 5292.6.5 | 8GR31-67 | 3 | 8.5 | 3.4 | 81.1 | 2.3 | 4.8 | Homoz Pos |
| 159-fad2-1b | PHP32511 | AFS 5292.6.5 | 8GR31-67 | 4 | 8.2 | 3.0 | 83.5 | 1.5 | 3.8 | Homoz Pos |
| 159-fad2-1b | PHP32511 | AFS 5292.6.5 | 8GR31-67 | 5 | 8.7 | 3.0 | 84.4 | 1.0 | 2.9 | Homoz Pos |
| 159-fad2-1b | PHP32511 | AFS 5292.6.5 | 8GR31-67 | 6 | 8.5 | 2.8 | 82.3 | 1.8 | 4.6 | Homoz Pos |
| 159-fad2-1b | PHP32511 | AFS 5292.6.5 | 8GR31-67 | 7 | 8.5 | 2.8 | 83.7 | 1.3 | 3.7 | Homoz Pos |
| 159-fad2-1b | PHP32511 | AFS 5292.6.5 | 8GR31-67 | 8 | 8.1 | 3.1 | 82.9 | 1.5 | 4.4 | Homoz Pos |
| 159-fad2-1b | PHP32511 | AFS 5292.6.5 | 8GR31-67 | 9 | 8.2 | 3.1 | 81.8 | 2.1 | 4.8 | Homoz Pos |
| 159-fad2-1b | PHP32511 | AFS 5292.6.5 | 8GR31-67 | 10 | 8.3 | 2.9 | 83.9 | 1.5 | 3.4 | Homoz Pos |
| 159-fad2-1b | PHP32511 | AFS 5292.7.2 | 8GR31-73 | 1 | 7.9 | 3.3 | 84.3 | 1.3 | 3.2 | Homoz Pos |
| 159-fad2-1b | PHP32511 | AFS 5292.7.2 | 8GR31-73 | 2 | 8.2 | 3.3 | 83.7 | 1.2 | 3.6 | Homoz Pos |
| 159-fad2-1b | PHP32511 | AFS 5292.7.2 | 8GR31-73 | 3 | 8.1 | 3.4 | 83.8 | 1.3 | 3.4 | Homoz Pos |
| 159-fad2-1b | PHP32511 | AFS 5292.7.2 | 8GR31-73 | 4 | 8.8 | 3.1 | 83.2 | 1.3 | 3.7 | Homoz Pos |
| 159-fad2-1b | PHP32511 | AFS 5292.7.2 | 8GR31-73 | 5 | 8.7 | 3.4 | 82.9 | 1.3 | 3.8 | Homoz Pos |
| 159-fad2-1b | PHP32511 | AFS 5292.7.2 | 8GR31-74 | 1 | | | | | | Homoz Pos |

TABLE 8-continued

Fatty acid profile for T2 seed analyzed from soy transformed with PHP32510, containing the 369b-fad2-1b amiRNA or PHP32511, containing the 159-fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b | PHP32511 | AFS 5292.7.2 | 8GR31-74 | 2 | 7.5 | 3.3 | 84.6 | 1.2 | 3.4 | Homoz Pos |
| 159-fad2-1b | PHP32511 | AFS 5292.7.2 | 8GR31-74 | 3 | 8.4 | 3.1 | 83.7 | 1.3 | 3.5 | Homoz Pos |
| 159-fad2-1b | PHP32511 | AFS 5292.7.2 | 8GR31-74 | 4 | 8.4 | 3.0 | 83.2 | 1.6 | 3.8 | Homoz Pos |
| 159-fad2-1b | PHP32511 | AFS 5292.7.2 | 8GR31-74 | 5 | 8.2 | 3.1 | 80.6 | 4.0 | 4.2 | Homoz Pos |
| 159-fad2-1b | PHP32511 | AFS 5292.7.2 | 8GR31-74 | 6 | 7.7 | 3.0 | 85.3 | 0.9 | 3.1 | Homoz Pos |
| 159-fad2-1b | PHP32511 | AFS 5292.7.2 | 8GR31-74 | 7 | 8.4 | 3.2 | 83.9 | 1.2 | 3.3 | Homoz Pos |
| 159-fad2-1b | PHP32511 | AFS 5292.7.2 | 8GR31-74 | 8 | 7.8 | 3.0 | 84.5 | 1.2 | 3.5 | Homoz Pos |
| 159-fad2-1b | PHP32511 | AFS 5292.7.2 | 8GR31-74 | 9 | 8.2 | 3.1 | 84.4 | 1.2 | 3.1 | Homoz Pos |
| 159-fad2-1b | PHP32511 | AFS 5292.7.2 | 8GR31-74 | 10 | 8.2 | 2.9 | 84.7 | 1.0 | 3.2 | Homoz Pos |
| 159-fad2-1b | PHP32511 | AFS 5292.7.2 | 8GR31-75 | 1 | 8.9 | 3.1 | 82.5 | 1.4 | 4.1 | Homoz Pos |
| 159-fad2-1b | PHP32511 | AFS 5292.7.2 | 8GR31-75 | 2 | 7.9 | 3.1 | 84.7 | 1.1 | 3.2 | Homoz Pos |
| 159-fad2-1b | PHP32511 | AFS 5292.7.2 | 8GR31-75 | 3 | 8.6 | 3.3 | 83.6 | 1.2 | 3.4 | Homoz Pos |
| 159-fad2-1b | PHP32511 | AFS 5292.7.2 | 8GR31-75 | 4 | 8.4 | 3.7 | 81.7 | 1.4 | 4.8 | Homoz Pos |
| 159-fad2-1b | PHP32511 | AFS 5292.7.2 | 8GR31-75 | 5 | 8.3 | 3.1 | 82.8 | 1.3 | 4.4 | Homoz Pos |
| 159-fad2-1b | PHP32511 | AFS 5292.7.2 | 8GR31-76 | 1 | 7.7 | 3.1 | 85.0 | 1.1 | 3.0 | Homoz Pos |
| 159-fad2-1b | PHP32511 | AFS 5292.7.2 | 8GR31-76 | 2 | 8.3 | 3.3 | 83.8 | 1.2 | 3.4 | Homoz Pos |
| 159-fad2-1b | PHP32511 | AFS 5292.7.2 | 8GR31-76 | 3 | 8.3 | 3.1 | 83.6 | 1.2 | 3.9 | Homoz Pos |
| 159-fad2-1b | PHP32511 | AFS 5292.7.2 | 8GR31-76 | 4 | 7.6 | 3.4 | 84.5 | 1.3 | 3.3 | Homoz Pos |
| 159-fad2-1b | PHP32511 | AFS 5292.7.2 | 8GR31-78 | 1 | 8.0 | 3.2 | 84.0 | 1.7 | 3.0 | Homoz Pos |
| 159-fad2-1b | PHP32511 | AFS 5292.7.2 | 8GR31-78 | 2 | 8.3 | 2.8 | 85.4 | 1.0 | 2.5 | Homoz Pos |
| 159-fad2-1b | PHP32511 | AFS 5292.7.2 | 8GR31-78 | 3 | 8.6 | 3.3 | 82.9 | 1.2 | 4.1 | Homoz Pos |
| 159-fad2-1b | PHP32511 | AFS 5292.7.2 | 8GR31-78 | 4 | 8.3 | 3.5 | 83.9 | 1.1 | 3.3 | Homoz Pos |
| 159-fad2-1b | PHP32511 | AFS 5292.7.2 | 8GR31-78 | 5 | 9.0 | 3.4 | 82.2 | 1.4 | 4.0 | Homoz Pos |
| 159-fad2-1b | PHP32511 | AFS 5292.7.6 | 8GR31-42 | 1 | 8.0 | 3.5 | 83.2 | 1.5 | 3.9 | Homoz Pos |

TABLE 8-continued

Fatty acid profile for T2 seed analyzed from soy transformed with
PHP32510, containing the 369b-fad2-1b amiRNA or PHP32511, containing the 159-
fad2-1b amiRNA grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b | PHP32511 | AFS 5292.7.6 | 8GR31-42 | 2 | 7.6 | 3.5 | 84.6 | 1.2 | 3.0 | Homoz Pos |
| 159-fad2-1b | PHP32511 | AFS 5292.7.6 | 8GR31-42 | 3 | 7.3 | 3.7 | 84.9 | 1.1 | 3.1 | Homoz Pos |
| 159-fad2-1b | PHP32511 | AFS 5292.7.6 | 8GR31-42 | 4 | 8.3 | 3.7 | 84.0 | 1.3 | 2.8 | Homoz Pos |
| 159-fad2-1b | PHP32511 | AFS 5292.7.6 | 8GR31-42 | 5 | 8.7 | 3.8 | 83.2 | 1.5 | 2.8 | Homoz Pos |
| 159-fad2-1b | PHP32511 | AFS 5292.7.6 | 8GR31-44 | 1 | 7.8 | 3.6 | 83.9 | 1.2 | 3.4 | Homoz Pos |
| 159-fad2-1b | PHP32511 | AFS 5292.7.6 | 8GR31-44 | 2 | | | | | | Homoz Pos |
| 159-fad2-1b | PHP32511 | AFS 5292.7.6 | 8GR31-44 | 3 | 8.0 | 3.4 | 83.6 | 1.4 | 3.6 | Homoz Pos |
| 159-fad2-1b | PHP32511 | AFS 5292.7.6 | 8GR31-44 | 4 | 8.2 | 3.4 | 84.1 | 1.1 | 3.2 | Homoz Pos |
| 159-fad2-1b | PHP32511 | AFS 5292.7.6 | 8GR31-44 | 5 | 8.2 | 3.5 | 83.1 | 1.9 | 3.3 | Homoz Pos |
| 159-fad2-1b | PHP32511 | AFS 5292.7.6 | 8GR31-44 | 6 | 8.0 | 3.3 | 83.8 | 1.3 | 3.6 | Homoz Pos |
| 159-fad2-1b | PHP32511 | AFS 5292.7.6 | 8GR31-44 | 7 | 7.7 | 3.7 | 84.0 | 1.2 | 3.4 | Homoz Pos |
| 159-fad2-1b | PHP32511 | AFS 5292.7.6 | 8GR31-44 | 8 | 7.7 | 3.6 | 84.1 | 1.4 | 3.3 | Homoz Pos |
| 159-fad2-1b | PHP32511 | AFS 5292.7.6 | 8GR31-44 | 9 | 7.6 | 3.3 | 84.5 | 1.2 | 3.3 | Homoz Pos |
| 159-fad2-1b | PHP32511 | AFS 5292.7.6 | 8GR31-44 | 10 | 7.8 | 3.3 | 84.2 | 1.2 | 3.4 | Homoz Pos |

Table 8 shows that T2 seed from null segregants have oleic acid contents ranging from 7.7% to 35% which is in the range for that of Jack seed which ranges from 12.7% to 17.9% (see Table 12). T2 seed from events expressing the 396b-fad2-1b amiRNA have oleic acid contents ranging from 78.6% to 85% and T2 seed from events expressing the 159-fad2-1b amiRNA have oleic acid contents ranging from 80.2% to 85.8%.

TABLE 9

Fatty acid profile for T2 seed analyzed from soy transformed with
PHP32843, containing the 369b-fad2-1b & 159-fad2-2 amiRNAs grown in the
greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b/159-fad2-2 | PHP32843 | AFS 5396.2.2 | 8GR31-140 | 1 | 7.5 | 3.0 | 87.2 | 0.4 | 1.7 | Homoz Pos |
| 396b-fad2-1b/159-fad2-2 | PHP32843 | AFS 5396.2.2 | 8GR31-140 | 2 | 7.9 | 2.9 | 85.5 | 0.5 | 1.9 | Homoz Pos |

TABLE 9-continued

Fatty acid profile for T2 seed analyzed from soy transformed with PHP32843, containing the 369b-fad2-1b & 159-fad2-2 amiRNAs grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b/159-fad2-2 | PHP32843 | AFS 5396.2.2 | 8GR31-140 | 3 | 7.7 | 2.8 | 87.4 | 0.3 | 1.7 | Homoz Pos |
| 396b-fad2-1b/159-fad2-2 | PHP32843 | AFS 5396.2.2 | 8GR31-140 | 4 | 8.2 | 3.0 | 85.5 | 0.6 | 1.9 | Homoz Pos |
| 396b-fad2-1b/159-fad2-2 | PHP32843 | AFS 5396.2.2 | 8GR31-140 | 5 | 7.8 | 3.1 | 86.9 | 0.4 | 1.6 | Homoz Pos |
| 396b-fad2-1b/159-fad2-2 | PHP32843 | AFS 5396.2.2 | 8GR31-140 | 6 | 7.6 | 2.7 | 86.2 | 0.4 | 1.6 | Homoz Pos |
| 396b-fad2-1b/159-fad2-2 | PHP32843 | AFS 5396.2.2 | 8GR31-140 | 7 | 7.8 | 3.1 | 86.7 | 0.4 | 1.8 | Homoz Pos |
| 396b-fad2-1b/159-fad2-2 | PHP32843 | AFS 5396.2.2 | 8GR31-140 | 8 | 8.2 | 2.9 | 85.1 | 0.4 | 1.9 | Homoz Pos |
| 396b-fad2-1b/159-fad2-2 | PHP32843 | AFS 5396.2.2 | 8GR31-140 | 9 | 7.3 | 3.2 | 87.3 | 03 | 1.7 | Homoz Pos |
| 396b-fad2-1b/159-fad2-2 | PHP32843 | AFS 5396.2.2 | 8GR31-140 | 10 | 7.7 | 3.2 | 85.7 | 0.5 | 1.8 | Homoz Pos |
| 396b-fad2-1b/159-fad2-2 | PHP32843 | AFS 5396.2.3 | 8GR31-145 | 1 | 7.5 | 3.2 | 86.4 | 0.8 | 2.0 | Homoz Pos |
| 396b-fad2-1b/159-fad2-2 | PHP32843 | AFS 5396.2.3 | 8GR31-145 | 2 | 8.0 | 3.0 | 85.6 | 0.4 | 1.8 | Homoz Pos |
| 396b-fad2-1b/159-fad2-2 | PHP32843 | AFS 5396.2.3 | 8GR31-145 | 3 | 8.0 | 2.9 | 87.0 | 0.4 | 1.6 | Homoz Pos |
| 396b-fad2-1b/159-fad2-2 | PHP32843 | AFS 5396.2.3 | 8GR31-145 | 4 | 7.6 | 2.7 | 86.5 | 0.4 | 1.8 | Homoz Pos |
| 396b-fad2-1b/159-fad2-2 | PHP32843 | AFS 5396.2.3 | 8GR31-145 | 5 | 7.4 | 2.9 | 87.6 | 0.3 | 1.7 | Homoz Pos |
| 396b-fad2-1b/159-fad2-2 | PHP32843 | AFS 5396.2.3 | 8GR31-145 | 6 | 7.4 | 2.9 | 86.5 | 0.4 | 1.6 | Homoz Pos |
| 396b-fad2-1b/159-fad2-2 | PHP32843 | AFS 5396.2.3 | 8GR31-145 | 7 | 7.4 | 3.3 | 87.0 | 0.3 | 1.8 | Homoz Pos |
| 396b-fad2-1b/159-fad2-2 | PHP32843 | AFS 5396.2.3 | 8GR31-145 | 8 | 7.0 | 2.9 | 87.2 | 0.3 | 1.5 | Homoz Pos |
| 396b-fad2-1b/159-fad2-2 | PHP32843 | AFS 5396.2.3 | 8GR31-145 | 9 | 7.3 | 2.9 | 87.4 | 0.3 | 1.8 | Homoz Pos |
| 396b-fad2-1b/159-fad2-2 | PHP32843 | AFS 5396.2.3 | 8GR31-145 | 10 | 7.3 | 3.1 | 86.2 | 0.4 | 1.8 | Homoz Pos |

TABLE 9-continued

Fatty acid profile for T2 seed analyzed from soy transformed with PHP32843, containing the 369b-fad2-1b & 159-fad2-2 amiRNAs grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b/159-fad2-2 | PHP32843 | AFS 5396.3.8 | 8GR31-156 | 1 | 7.4 | 3.4 | 86.4 | 0.4 | 2.2 | Homoz Pos |
| 396b-fad2-1b/159-fad2-2 | PHP32843 | AFS 5396.3.8 | 8GR31-156 | 2 | 9.3 | 3.1 | 82.3 | 0.7 | 3.3 | Homoz Pos |
| 396b-fad2-1b/159-fad2-2 | PHP32843 | AFS 5396.3.8 | 8GR31-156 | 3 | 8.1 | 2.9 | 86.6 | 0.3 | 2.0 | Homoz Pos |
| 396b-fad2-1b/159-fad2-2 | PHP32843 | AFS 5396.3.8 | 8GR31-156 | 4 | 6.9 | 3.2 | 86.6 | 0.5 | 1.7 | Homoz Pos |
| 396b-fad2-1b/159-fad2-2 | PHP32843 | AFS 5396.3.8 | 8GR31-156 | 5 | 8.1 | 3.3 | 85.3 | 0.4 | 2.6 | Homoz Pos |
| 396b-fad2-1b/159-fad2-2 | PHP32843 | AFS 5396.3.8 | 8GR31-156 | 6 | 7.3 | 3.1 | 85.9 | 0.4 | 2.0 | Homoz Pos |
| 396b-fad2-1b/159-fad2-2 | PHP32843 | AFS 5396.3.8 | 8GR31-156 | 7 | 6.7 | 3.1 | 87.9 | 0.3 | 1.8 | Homoz Pos |
| 396b-fad2-1b/159-fad2-2 | PHP32843 | AFS 5396.3.8 | 8GR31-156 | 8 | 7.5 | 3.5 | 85.1 | 0.5 | 2.0 | Homoz Pos |
| 396b-fad2-1b/159-fad2-2 | PHP32843 | AFS 5396.3.8 | 8GR31-156 | 9 | 6.7 | 3.3 | 87.6 | 0.4 | 1.8 | Homoz Pos |
| 396b-fad2-1b/159-fad2-2 | PHP32843 | AFS 5396.3.8 | 8GR31-156 | 10 | 8.0 | 3.4 | 84.7 | 0.5 | 2.3 | Homoz Pos |
| 396b-fad2-1b/159-fad2-2 | PHP32843 | AFS 5396.3.8 | 8GR31-157 | 1 | 6.8 | 3.3 | 86.9 | 0.5 | 2.2 | Homoz Pos |
| 396b-fad2-1b/159-fad2-2 | PHP32843 | AFS 5396.3.8 | 8GR31-157 | 2 | 7.1 | 3.2 | 86.0 | 0.4 | 1.8 | Homoz Pos |
| 396b-fad2-1b/159-fad2-2 | PHP32843 | AFS 5396.3.8 | 8GR31-157 | 3 | 7.2 | 2.7 | 87.5 | 0.4 | 1.9 | Homoz Pos |
| 396b-fad2-1b/159-fad2-2 | PHP32843 | AFS 5396.3.8 | 8GR31-157 | 4 | 7.1 | 3.3 | 88.0 | 0.4 | 0.0 | Homoz Pos |
| 396b-fad2-1b/159-fad2-2 | PHP32843 | AFS 5396.3.8 | 8GR31-157 | 5 | 7.0 | 2.9 | 87.5 | 0.4 | 2.0 | Homoz Pos |
| 396b-fad2-1b/159-fad2-2 | PHP32843 | AFS 5396.3.8 | 8GR31-157 | 6 | 6.6 | 3.8 | 86.1 | 0.4 | 1.7 | Homoz Pos |
| 396b-fad2-1b/159-fad2-2 | PHP32843 | AFS 5396.3.8 | 8GR31-157 | 7 | 7.4 | 2.9 | 87.5 | 0.3 | 1.8 | Homoz Pos |
| 396b-fad2-1b/159-fad2-2 | PHP32843 | AFS 5396.3.8 | 8GR31-157 | 8 | 6.9 | 2.5 | 86.8 | 0.7 | 2.1 | Homoz Pos |

TABLE 9-continued

Fatty acid profile for T2 seed analyzed from soy transformed with PHP32843, containing the 369b-fad2-1b & 159-fad2-2 amiRNAs grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396b-fad2-1b/159-fad2-2 | PHP32843 | AFS 5396.3.8 | 8GR31-157 | 9 | 7.1 | 2.8 | 87.7 | 0.3 | 1.8 | Homoz Pos |
| 396b-fad2-1b/159-fad2-2 | PHP32843 | AFS 5396.3.8 | 8GR31-157 | 10 | 7.1 | 3.2 | 85.6 | 0.7 | 2.3 | Homoz Pos |

Table 9 shows that T2 seed from events expressing the 369b-fad2-1b & 159-fad2-2 amiRNAs have oleic acid contents ranging from 82.3% to 88.0%. These oleic acid contents are higher than that observed for either the 396b-fad2-1b or 159-fad2-1b amiRNA when expressed individually.

TABLE 10

Fatty acid profile for T2 seed analyzed from soy transformed with PHP33705, containing the 396-fad2-1b & 396b-sad3 amiRNAs grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396-fad2-1b/396b-sad3 | PHP33705 | AFS 5489.3.2 | 10GR13-7 | 1 | 10.2 | 3.9 | 13.6 | 60.2 | 12.0 | Null |
| 396-fad2-1b/396b-sad3 | PHP33705 | AFS 5489.3.2 | 10GR13-7 | 2 | 10.8 | 3.6 | 13.3 | 62.3 | 10.0 | Null |
| 396-fad2-1b/396b-sad3 | PHP33705 | AFS 5489.3.2 | 10GR13-8 | 1 | 10.5 | 3.4 | 16.3 | 61.0 | 8.7 | Null |
| 396-fad2-1b/396b-sad3 | PHP33705 | AFS 5489.3.2 | 10GR13-8 | 2 | 11.0 | 2.9 | 17.2 | 60.7 | 8.2 | Null |
| 396-fad2-1b/396b-sad3 | PHP33705 | AFS 5489.3.2 | 10GR13-6 | 1 | 6.4 | 11.4 | 75.4 | 1.8 | 5.0 | Homoz Pos |
| 396-fad2-1b/396b-sad3 | PHP33705 | AFS 5489.3.2 | 10GR13-6 | 2 | 5.8 | 12.9 | 73.2 | 2.0 | 6.0 | Homoz Pos |
| 396-fad2-1b/396b-sad3 | PHP33705 | AFS 5489.3.2 | 10GR13-6 | 3 | 6.2 | 14.2 | 72.7 | 1.8 | 5.1 | Homoz Pos |
| 396-fad2-1b/396b-sad3 | PHP33705 | AFS 5489.3.2 | 10GR13-6 | 4 | 5.7 | 17.8 | 69.1 | 1.8 | 5.5 | Homoz Pos |
| 396-fad2-1b/396b-sad3 | PHP33705 | AFS 5489.3.2 | 10GR13-6 | 5 | 5.5 | 13.6 | 72.3 | 2.5 | 6.1 | Homoz Pos |
| 396-fad2-1b/396b-sad3 | PHP33705 | AFS 5489.3.2 | 10GR13-6 | 6 | 6.1 | 12.8 | 73.4 | 2.1 | 5.6 | Homoz Pos |
| 396-fad2-1b/396b-sad3 | PHP33705 | AFS 5489.3.2 | 10GR13-6 | 7 | 5.6 | 13.6 | 73.2 | 2.1 | 5.5 | Homoz Pos |
| 396-fad2-1b/396b-sad3 | PHP33705 | AFS 5489.3.2 | 10GR13-6 | 8 | 6.2 | 11.4 | 74.1 | 2.4 | 5.9 | Homoz Pos |
| 396-fad2-1b/396b-sad3 | PHP33705 | AFS 5489.3.2 | 10GR13-6 | 9 | 6.4 | 13.2 | 73.8 | 2.1 | 4.6 | Homoz Pos |
| 396-fad2-1b/396b-sad3 | PHP33705 | AFS 5489.3.2 | 10GR13-6 | 10 | 6.0 | 13.2 | 73.9 | 1.8 | 5.2 | Homoz Pos |
| 396-fad2-1b/396b-sad3 | PHP33705 | AFS 5489.3.4 | 10GR13-17 | 1 | 10.1 | 3.8 | 14.8 | 59.2 | 12.0 | Null |

TABLE 10-continued

Fatty acid profile for T2 seed analyzed from soy transformed with
PHP33705, containing the 396-fad2-1b & 396b-sad3 amiRNAs grown in the
greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396-fad2-1b/396b-sad3 | PHP33705 | AFS 5489.3.4 | 10GR13-17 | 2 | 12.3 | 3.4 | 16.8 | 57.9 | 9.7 | Null |
| 396-fad2-1b/396b-sad3 | PHP33705 | AFS 5489.3.4 | 10GR13-14 | 1 | 6.6 | 10.3 | 71.9 | 3.4 | 7.8 | Homoz Pos |
| 396-fad2-1b/396b-sad3 | PHP33705 | AFS 5489.3.4 | 10GR13-14 | 2 | 6.1 | 11.2 | 74.1 | 2.9 | 5.7 | Homoz Pos |
| 396-fad2-1b/396b-sad3 | PHP33705 | AFS 5489.3.4 | 10GR13-14 | 3 | 5.0 | 13.5 | 72.2 | 3.0 | 6.4 | Homoz Pos |
| 396-fad2-1b/396b-sad3 | PHP33705 | AFS 5489.3.4 | 10GR13-14 | 4 | 6.2 | 10.5 | 76.0 | 1.9 | 5.4 | Homoz Pos |
| 396-fad2-1b/396b-sad3 | PHP33705 | AFS 5489.3.4 | 10GR13-14 | 5 | 5.9 | 12.1 | 74.6 | 1.7 | 5.7 | Homoz Pos |
| 396-fad2-1b/396b-sad3 | PHP33705 | AFS 5489.3.4 | 10GR13-14 | 6 | 5.5 | 13.5 | 74.6 | 1.7 | 4.7 | Homoz Pos |
| 396-fad2-1b/396b-sad3 | PHP33705 | AFS 5489.3.4 | 10GR13-14 | 7 | 5.1 | 12.9 | 73.5 | 2.5 | 5.9 | Homoz Pos |
| 396-fad2-1b/396b-sad3 | PHP33705 | AFS 5489.3.4 | 10GR13-14 | 8 | 5.4 | 13.4 | 73.7 | 2.2 | 5.2 | Homoz Pos |
| 396-fad2-1b/396b-sad3 | PHP33705 | AFS 5489.3.4 | 10GR13-14 | 9 | 5.6 | 13.0 | 70.6 | 3.6 | 7.1 | Homoz Pos |
| 396-fad2-1b/396b-sad3 | PHP33705 | AFS 5489.3.4 | 10GR13-14 | 10 | 5.7 | 12.4 | 74.8 | 1.7 | 5.3 | Homoz Pos |
| 396-fad2-1b/396b-sad3 | PHP33705 | AFS 5489.3.4 | 10GR13-15 | 1 | 5.8 | 10.6 | 77.2 | 1.7 | 4.6 | Homoz Pos |
| 396-fad2-1b/396b-sad3 | PHP33705 | AFS 5489.3.4 | 10GR13-15 | 2 | 6.2 | 11.8 | 73.4 | 2.7 | 5.9 | Homoz Pos |
| 396-fad2-1b/396b-sad3 | PHP33705 | AFS 5489.3.4 | 10GR13-15 | 3 | 5.5 | 10.7 | 76.6 | 1.9 | 5.3 | Homoz Pos |
| 396-fad2-1b/396b-sad3 | PHP33705 | AFS 5489.3.4 | 10GR13-15 | 4 | 5.8 | 10.7 | 77.5 | 1.6 | 4.4 | Homoz Pos |
| 396-fad2-1b/396b-sad3 | PHP33705 | AFS 5489.3.4 | 10GR13-15 | 5 | 5.6 | 11.3 | 76.8 | 1.7 | 4.7 | Homoz Pos |
| 396-fad2-1b/396b-sad3 | PHP33705 | AFS 5489.3.4 | 10GR13-15 | 6 | 5.4 | 13.9 | 75.1 | 1.3 | 4.3 | Homoz Pos |
| 396-fad2-1b/396b-sad3 | PHP33705 | AFS 5489.3.4 | 10GR13-15 | 7 | 5.6 | 12.7 | 73.7 | 2.5 | 5.4 | Homoz Pos |
| 396-fad2-1b/396b-sad3 | PHP33705 | AFS 5489.3.4 | 10GR13-15 | 8 | 5.9 | 12.3 | 72.8 | 3.0 | 6.0 | Homoz Pos |
| 396-fad2-1b/396b-sad3 | PHP33705 | AFS 5489.3.4 | 10GR13-15 | 9 | 5.3 | 11.7 | 77.3 | 1.5 | 4.2 | Homoz Pos |
| 396-fad2-1b/396b-sad3 | PHP33705 | AFS 5489.3.4 | 10GR13-15 | 10 | 5.5 | 14.0 | 72.5 | 2.8 | 5.2 | Homoz Pos |
| 396-fad2-1b/396b-sad3 | PHP33705 | AFS 5489.3.4 | 10GR13-16 | 1 | 6.8 | 8.0 | 78.8 | 1.7 | 4.6 | Homoz Pos |
| 396-fad2-1b/396b-sad3 | PHP33705 | AFS 5489.3.4 | 10GR13-16 | 2 | 6.4 | 9.6 | 76.7 | 2.0 | 5.3 | Homoz Pos |
| 396-fad2-1b/396b-sad3 | PHP33705 | AFS 5489.3.4 | 10GR13-16 | 3 | 6.6 | 8.5 | 78.5 | 1.6 | 4.8 | Homoz Pos |

TABLE 10-continued

Fatty acid profile for T2 seed analyzed from soy transformed with PHP33705, containing the 396-fad2-1b & 396b-sad3 amiRNAs grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396-fad2-1b/396b-sad3 | PHP33705 | AFS 5489.3.4 | 10GR13-16 | 4 | 6.6 | 8.4 | 78.7 | 1.5 | 4.7 | Homoz Pos |
| 396-fad2-1b/396b-sad3 | PHP33705 | AFS 5489.3.4 | 10GR13-16 | 5 | 6.2 | 10.7 | 77.4 | 1.5 | 4.2 | Homoz Pos |
| 396-fad2-1b/396b-sad3 | PHP33705 | AFS 5489.3.4 | 10GR13-16 | 6 | 6.6 | 8.6 | 78.9 | 1.5 | 4.4 | Homoz Pos |
| 396-fad2-1b/396b-sad3 | PHP33705 | AFS 5489.3.4 | 10GR13-16 | 7 | 6.5 | 10.1 | 77.8 | 1.1 | 4.5 | Homoz Pos |
| 396-fad2-1b/396b-sad3 | PHP33705 | AFS 5489.3.4 | 10GR13-16 | 8 | 6.3 | 9.4 | 78.2 | 1.5 | 4.6 | Homoz Pos |
| 396-fad2-1b/396b-sad3 | PHP33705 | AFS 5489.3.4 | 10GR13-16 | 9 | 6.3 | 10.5 | 77.3 | 1.6 | 4.4 | Homoz Pos |
| 396-fad2-1b/396b-sad3 | PHP33705 | AFS 5489.3.4 | 10GR13-16 | 10 | 6.4 | 8.5 | 78.5 | 1.5 | 5.1 | Homoz Pos |
| 396-fad2-1b/396b-sad3 | PHP33705 | AFS 5489.3.4 | 10GR13-19 | 1 | 6.6 | 9.9 | 74.5 | 3.1 | 5.9 | Homoz Pos |
| 396-fad2-1b/396b-sad3 | PHP33705 | AFS 5489.3.4 | 10GR13-19 | 2 | 6.8 | 8.5 | 74.7 | 3.5 | 6.5 | Homoz Pos |
| 396-fad2-1b/396b-sad3 | PHP33705 | AFS 5489.3.4 | 10GR13-19 | 3 | 5.4 | 10.5 | 76.2 | 2.4 | 5.5 | Homoz Pos |
| 396-fad2-1b/396b-sad3 | PHP33705 | AFS 5489.3.4 | 10GR13-19 | 4 | 6.1 | 11.1 | 75.4 | 2.4 | 5.0 | Homoz Pos |
| 396-fad2-1b/396b-sad3 | PHP33705 | AFS 5489.3.4 | 10GR13-19 | 5 | 6.8 | 9.4 | 73.1 | 4.0 | 6.7 | Homoz Pos |
| 396-fad2-1b/396b-sad3 | PHP33705 | AFS 5489.3.4 | 10GR13-19 | 6 | 6.4 | 9.1 | 77.6 | 1.9 | 4.9 | Homoz Pos |
| 396-fad2-1b/396b-sad3 | PHP33705 | AFS 5489.3.4 | 10GR13-19 | 7 | 5.4 | 11.1 | 76.9 | 1.6 | 5.0 | Homoz Pos |
| 396-fad2-1b/396b-sad3 | PHP33705 | AFS 5489.3.4 | 10GR13-19 | 8 | 6.2 | 8.6 | 78.3 | 1.9 | 5.0 | Homoz Pos |
| 396-fad2-1b/396b-sad3 | PHP33705 | AFS 5489.3.4 | 10GR13-19 | 9 | 6.1 | 11.2 | 73.0 | 3.4 | 6.4 | Homoz Pos |
| 396-fad2-1b/396b-sad3 | PHP33705 | AFS 5489.3.4 | 10GR13-19 | 10 | 5.8 | 11.6 | 74.9 | 2.3 | 5.4 | Homoz Pos |
| 396-fad2-1b/396b-sad3 | PHP33705 | AFS 5489.3.4 | 10GR13-20 | 1 | 5.2 | 11.3 | 77.8 | 1.4 | 4.3 | Homoz Pos |
| 396-fad2-1b/396b-sad3 | PHP33705 | AFS 5489.3.4 | 10GR13-20 | 2 | 6.2 | 8.1 | 79.1 | 1.6 | 4.9 | Homoz Pos |
| 396-fad2-1b/396b-sad3 | PHP33705 | AFS 5489.3.4 | 10GR13-20 | 3 | 6.0 | 10.4 | 77.9 | 1.5 | 4.2 | Homoz Pos |
| 396-fad2-1b/396b-sad3 | PHP33705 | AFS 5489.3.4 | 10GR13-20 | 4 | 6.4 | 9.7 | 75.4 | 2.6 | 5.9 | Homoz Pos |
| 396-fad2-1b/396b-sad3 | PHP33705 | AFS 5489.3.4 | 10GR13-20 | 5 | 5.2 | 10.9 | 78.0 | 1.5 | 4.4 | Homoz Pos |
| 396-fad2-1b/396b-sad3 | PHP33705 | AFS 5489.3.4 | 10GR13-20 | 6 | 6.3 | 9.9 | 74.9 | 2.9 | 6.1 | Homoz Pos |
| 396-fad2-1b/396b-sad3 | PHP33705 | AFS 5489.3.4 | 10GR13-20 | 7 | 6.3 | 10.0 | 76.6 | 2.0 | 5.1 | Homoz Pos |

TABLE 10-continued

Fatty acid profile for T2 seed analyzed from soy transformed with PHP33705, containing the 396-fad2-1b & 396b-sad3 amiRNAs grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396-fad2-1b/396b-sad3 | PHP33705 | AFS 5489.3.4 | 10GR13-20 | 8 | 6.7 | 9.1 | 77.4 | 1.9 | 5.0 | Homoz Pos |
| 396-fad2-1b/396b-sad3 | PHP33705 | AFS 5489.3.4 | 10GR13-20 | 9 | 5.3 | 10.1 | 76.4 | 2.7 | 5.5 | Homoz Pos |
| 396-fad2-1b/396b-sad3 | PHP33705 | AFS 5489.3.4 | 10GR13-20 | 10 | 5.5 | 13.3 | 73.7 | 2.3 | 5.1 | Homoz Pos |
| 396-fad2-1b/396b-sad3 | PHP33705 | AFS 5489.3.4 | 10GR13-23 | 1 | 6.6 | 9.8 | 76.6 | 2.1 | 4.9 | Homoz Pos |
| 396-fad2-1b/396b-sad3 | PHP33705 | AFS 5489.3.4 | 10GR13-23 | 2 | 6.3 | 10.9 | 76.3 | 1.8 | 4.7 | Homoz Pos |
| 396-fad2-1b/396b-sad3 | PHP33705 | AFS 5489.3.4 | 10GR13-23 | 3 | 6.7 | 17.3 | 68.8 | 1.7 | 5.6 | Homoz Pos |
| 396-fad2-1b/396b-sad3 | PHP33705 | AFS 5489.3.4 | 10GR13-23 | 4 | 5.7 | 11.2 | 76.3 | 1.7 | 5.1 | Homoz Pos |
| 396-fad2-1b/396b-sad3 | PHP33705 | AFS 5489.3.4 | 10GR13-23 | 5 | 6.3 | 11.5 | 75.2 | 1.7 | 5.3 | Homoz Pos |
| 396-fad2-1b/396b-sad3 | PHP33705 | AFS 5489.3.4 | 10GR13-23 | 6 | 6.7 | 9.1 | 76.8 | 2.1 | 5.3 | Homoz Pos |
| 396-fad2-1b/396b-sad3 | PHP33705 | AFS 5489.3.4 | 10GR13-23 | 7 | 6.8 | 10.8 | 75.1 | 1.9 | 5.4 | Homoz Pos |
| 396-fad2-1b/396b-sad3 | PHP33705 | AFS 5489.3.4 | 10GR13-23 | 8 | 6.2 | 12.6 | 75.4 | 1.4 | 4.4 | Homoz Pos |
| 396-fad2-1b/396b-sad3 | PHP33705 | AFS 5489.3.4 | 10GR13-23 | 9 | 5.8 | 10.4 | 77.1 | 1.7 | 5.0 | Homoz Pos |
| 396-fad2-1b/396b-sad3 | PHP33705 | AFS 5489.3.4 | 10GR13-23 | 10 | 6.1 | 9.5 | 77.7 | 1.7 | 5.0 | Homoz Pos |
| 396-fad2-1b/396b-sad3 | PHP33705 | AFS 5489.4.1 | 10GR13-48 | 1 | 10.4 | 4.2 | 16.1 | 59.0 | 10.3 | Null |
| 396-fad2-1b/396b-sad3 | PHP33705 | AFS 5489.4.1 | 10GR13-48 | 2 | 12.2 | 3.8 | 14.4 | 57.8 | 11.8 | Null |
| 396-fad2-1b/396b-sad3 | PHP33705 | AFS 5489.4.1 | 10GR13-53 | 1 | 10.5 | 4.4 | 18.3 | 57.6 | 9.1 | Null |
| 396-fad2-1b/396b-sad3 | PHP33705 | AFS 5489.4.1 | 10GR13-53 | 2 | 11.8 | 3.7 | 15.5 | 59.3 | 9.7 | Null |
| 396-fad2-1b/396b-sad3 | PHP33705 | AFS 5489.4.1 | 10GR13-54 | 1 | 5.6 | 14.5 | 71.5 | 2.6 | 5.8 | Homoz Pos |
| 396-fad2-1b/396b-sad3 | PHP33705 | AFS 5489.4.1 | 10GR13-54 | 2 | 5.6 | 18.0 | 68.7 | 1.9 | 5.8 | Homoz Pos |
| 396-fad2-1b/396b-sad3 | PHP33705 | AFS 5489.4.1 | 10GR13-54 | 3 | 5.5 | 12.7 | 74.6 | 1.9 | 5.3 | Homoz Pos |
| 396-fad2-1b/396b-sad3 | PHP33705 | AFS 5489.4.1 | 10GR13-54 | 4 | 5.5 | 17.8 | 69.1 | 2.2 | 5.3 | Homoz Pos |
| 396-fad2-1b/396b-sad3 | PHP33705 | AFS 5489.4.1 | 10GR13-54 | 5 | 5.6 | 17.2 | 70.0 | 1.9 | 5.3 | Homoz Pos |
| 396-fad2-1b/396b-sad3 | PHP33705 | AFS 5489.4.1 | 10GR13-54 | 6 | 5.9 | 21.0 | 66.2 | 1.6 | 5.3 | Homoz Pos |
| 396-fad2-1b/396b-sad3 | PHP33705 | AFS 5489.4.1 | 10GR13-54 | 7 | 5.1 | 17.4 | 69.9 | 2.1 | 5.5 | Homoz Pos |

TABLE 10-continued

Fatty acid profile for T2 seed analyzed from soy transformed with PHP33705, containing the 396-fad2-1b & 396b-sad3 amiRNAs grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 396-fad2-1b/396b-sad3 | PHP33705 | AFS 5489.4.1 | 10GR13-54 | 8 | 5.7 | 18.5 | 68.1 | 2.2 | 5.5 | Homoz Pos |
| 396-fad2-1b/396b-sad3 | PHP33705 | AFS 5489.4.1 | 10GR13-54 | 9 | 5.8 | 15.7 | 71.1 | 2.1 | 5.3 | Homoz Pos |
| 396-fad2-1b/396b-sad3 | PHP33705 | AFS 5489.4.1 | 10GR13-54 | 10 | 5.3 | 18.9 | 68.6 | 1.9 | 5.4 | Homoz Pos |
| 396-fad2-1b/396b-sad3 | PHP33705 | AFS 5489.4.1 | 10GR13-56 | 1 | 5.7 | 17.3 | 70.0 | 2.0 | 5.0 | Homoz Pos |
| 396-fad2-1b/396b-sad3 | PHP33705 | AFS 5489.4.1 | 10GR13-56 | 2 | 5.5 | 16.3 | 71.2 | 2.1 | 4.9 | Homoz Pos |
| 396-fad2-1b/396b-sad3 | PHP33705 | AFS 5489.4.1 | 10GR13-56 | 3 | 5.5 | 19.1 | 66.7 | 2.4 | 6.3 | Homoz Pos |
| 396-fad2-1b/396b-sad3 | PHP33705 | AFS 5489.4.1 | 10GR13-56 | 4 | 5.4 | 21.4 | 64.8 | 2.4 | 6.0 | Homoz Pos |
| 396-fad2-1b/396b-sad3 | PHP33705 | AFS 5489.4.1 | 10GR13-56 | 5 | 6.1 | 15.9 | 69.5 | 2.2 | 6.2 | Homoz Pos |
| 396-fad2-1b/396b-sad3 | PHP33705 | AFS 5489.4.1 | 10GR13-56 | 6 | 5.5 | 13.1 | 75.3 | 1.8 | 4.3 | Homoz Pos |
| 396-fad2-1b/396b-sad3 | PHP33705 | AFS 5489.4.1 | 10GR13-56 | 7 | 4.9 | 17.6 | 71.1 | 2.0 | 4.4 | Homoz Pos |
| 396-fad2-1b/396b-sad3 | PHP33705 | AFS 5489.4.1 | 10GR13-56 | 8 | 5.1 | 16.1 | 71.8 | 2.1 | 5.0 | Homoz Pos |
| 396-fad2-1b/396b-sad3 | PHP33705 | AFS 5489.4.1 | 10GR13-56 | 9 | 4.8 | 17.0 | 70.0 | 2.0 | 6.2 | Homoz Pos |
| 396-fad2-1b/396b-sad3 | PHP33705 | AFS 5489.4.1 | 10GR13-56 | 10 | 5.4 | 17.9 | 69.2 | 2.0 | 5.6 | Homoz Pos |
| 396-fad2-1b/396b-sad3 | PHP33705 | AFS 5489.4.1 | 10GR13-60 | 1 | 6.1 | 13.3 | 67.7 | 5.7 | 7.2 | Homoz Pos |
| 396-fad2-1b/396b-sad3 | PHP33705 | AFS 5489.4.1 | 10GR13-60 | 2 | 4.9 | 12.9 | 76.0 | 1.6 | 4.7 | Homoz Pos |
| 396-fad2-1b/396b-sad3 | PHP33705 | AFS 5489.4.1 | 10GR13-60 | 3 | 4.5 | 15.4 | 72.5 | 2.0 | 5.6 | Homoz Pos |
| 396-fad2-1b/396b-sad3 | PHP33705 | AFS 5489.4.1 | 10GR13-60 | 4 | 5.2 | 12.9 | 74.7 | 2.0 | 5.1 | Homoz Pos |
| 396-fad2-1b/396b-sad3 | PHP33705 | AFS 5489.4.1 | 10GR13-60 | 5 | 6.2 | 14.2 | 71.2 | 2.3 | 6.1 | Homoz Pos |
| 396-fad2-1b/396b-sad3 | PHP33705 | AFS 5489.4.1 | 10GR13-60 | 6 | 5.6 | 11.3 | 75.9 | 1.8 | 5.4 | Homoz Pos |
| 396-fad2-1b/396b-sad3 | PHP33705 | AFS 5489.4.1 | 10GR13-60 | 7 | 4.8 | 17.5 | 71.7 | 1.6 | 4.5 | Homoz Pos |
| 396-fad2-1b/396b-sad3 | PHP33705 | AFS 5489.4.1 | 10GR13-60 | 8 | 5.2 | 15.2 | 71.4 | 2.4 | 5.8 | Homoz Pos |
| 396-fad2-1b/396b-sad3 | PHP33705 | AFS 5489.4.1 | 10GR13-60 | 9 | 6.1 | 10.9 | 74.3 | 2.2 | 6.5 | Homoz Pos |
| 396-fad2-1b/396b-sad3 | PHP33705 | AFS 5489.4.1 | 10GR13-60 | 10 | 4.7 | 15.3 | 73.3 | 2.0 | 4.6 | Homoz Pos |

Table 10 shows that T2 seed from events expressing the 396-fad2-1b & 396b-sad3 amiRNAs have palmitic acid contents ranging from 8.0% to 22.4% and have oleic acid contents ranging from 74.0% to 79.1%. T2 seed from null segregant seed have palmitic acid contents ranging from 2.9% to 4.4% and have oleic acid contents ranging from 13.3% to 20.1% which is in the range for that of Jack seed where palmitic acid ranges from 11.8% to 12.6% and oleic acid ranges from 12.7% to 17.9% (see Table 12).

TABLE 11

Fatty acid profile for T2 seed analyzed from soy transformed with PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.1.4 | 10GR13-66 | 1 | 11.5 | 3.0 | 22.2 | 54.9 | 8.3 | Null |
| 159-fad3c | PHP38557 | AFS 6272.1.4 | 10GR13-66 | 2 | 11.1 | 2.9 | 20.7 | 56.7 | 8.7 | Null |
| 159-fad3c | PHP38557 | AFS 6272.1.4 | 10GR13-70 | 1 | 10.2 | 3.4 | 18.3 | 59.8 | 8.2 | Null |
| 159-fad3c | PHP38557 | AFS 6272.1.4 | 10GR13-70 | 2 | 10.8 | 2.9 | 15.3 | 61.7 | 9.4 | Null |
| 159-fad3c | PHP38557 | AFS 6272.1.4 | 10GR13-63 | 1 | 11.7 | 3.5 | 18.8 | 64.9 | 1.1 | Homoz Pos |
| 159-fad3c | PHP38557 | AFS 6272.1.4 | 10GR13-63 | 2 | 10.7 | 3.9 | 15.6 | 68.8 | 1.0 | Homoz Pos |
| 159-fad3c | PHP38557 | AFS 6272.1.4 | 10GR13-63 | 3 | 10.2 | 3.1 | 18.6 | 66.7 | 1.3 | Homoz Pos |
| 159-fad3c | PHP38557 | AFS 6272.1.4 | 10GR13-63 | 4 | 11.6 | 3.6 | 17.6 | 66.0 | 1.2 | Homoz Pos |
| 159-fad3c | PHP38557 | AFS 6272.1.4 | 10GR13-63 | 5 | 11.2 | 3.3 | 16.0 | 68.4 | 1.2 | Homoz Pos |
| 159-fad3c | PHP38557 | AFS 6272.1.4 | 10GR13-63 | 6 | 11.5 | 2.9 | 21.4 | 63.2 | 1.0 | Homoz Pos |
| 159-fad3c | PHP38557 | AFS 6272.1.4 | 10GR13-63 | 7 | 11.5 | 3.2 | 16.9 | 67.2 | 1.2 | Homoz Pos |
| 159-fad3c | PHP38557 | AFS 6272.1.4 | 10GR13-63 | 8 | 11.5 | 2.9 | 18.3 | 66.3 | 1.0 | Homoz Pos |
| 159-fad3c | PHP38557 | AFS 6272.1.4 | 10GR13-63 | 9 | 11.3 | 3.1 | 19.8 | 64.7 | 1.1 | Homoz Pos |
| 159-fad3c | PHP38557 | AFS 6272.1.4 | 10GR13-63 | 10 | 12.8 | 3.5 | 16.4 | 66.1 | 1.2 | Homoz Pos |
| 159-fad3c | PHP38557 | AFS 6272.1.4 | 10GR13-65 | 1 | 12.0 | 3.2 | 15.9 | 66.8 | 2.1 | Homoz Pos |
| 159-fad3c | PHP38557 | AFS 6272.1.4 | 10GR13-65 | 2 | 12.0 | 3.0 | 16.8 | 66.4 | 1.8 | Homoz Pos |
| 159-fad3c | PHP38557 | AFS 6272.1.4 | 10GR13-65 | 3 | 12.0 | 3.3 | 17.2 | 65.9 | 1.6 | Homoz Pos |
| 159-fad3c | PHP38557 | AFS 6272.1.4 | 10GR13-65 | 4 | 12.1 | 3.0 | 18.7 | 64.6 | 1.6 | Homoz Pos |
| 159-fad3c | PHP38557 | AFS 6272.1.4 | 10GR13-65 | 5 | 11.8 | 3.2 | 17.4 | 65.8 | 1.8 | Homoz Pos |
| 159-fad3c | PHP38557 | AFS 6272.1.4 | 10GR13-65 | 6 | 13.2 | 3.1 | 17.8 | 64.6 | 1.4 | Homoz Pos |
| 159-fad3c | PHP38557 | AFS 6272.1.4 | 10GR13-65 | 8 | 12.6 | 3.2 | 15.1 | 66.7 | 2.3 | Homoz Pos |
| 159-fad3c | PHP38557 | AFS 6272.1.4 | 10GR13-65 | 9 | 13.3 | 3.7 | 15.2 | 66.3 | 1.5 | Homoz Pos |
| 159-fad3c | PHP38557 | AFS 6272.1.4 | 10GR13-65 | 10 | 12.6 | 3.5 | 15.9 | 66.6 | 1.4 | Homoz Pos |
| 159-fad3c | PHP38557 | AFS 6272.1.4 | 10GR13-73 | 1 | 11.4 | 3.4 | 19.4 | 64.7 | 1.1 | Homoz Pos |
| 159-fad3c | PHP38557 | AFS 6272.1.4 | 10GR13-73 | 2 | 12.3 | 3.2 | 15.9 | 67.1 | 1.5 | Homoz Pos |
| 159-fad3c | PHP38557 | AFS 6272.1.4 | 10GR13-73 | 3 | 11.4 | 3.2 | 16.5 | 67.7 | 1.3 | Homoz Pos |
| 159-fad3c | PHP38557 | AFS 6272.1.4 | 10GR13-73 | 4 | 12.8 | 3.5 | 19.8 | 62.8 | 1.1 | Homoz Pos |
| 159-fad3c | PHP38557 | AFS 6272.1.4 | 10GR13-73 | 5 | 11.0 | 3.7 | 14.8 | 69.2 | 1.3 | Homoz Pos |
| 159-fad3c | PHP38557 | AFS 6272.1.4 | 10GR13-73 | 6 | 12.3 | 3.8 | 19.2 | 63.7 | 1.0 | Homoz Pos |
| 159-fad3c | PHP38557 | AFS 6272.1.4 | 10GR13-73 | 7 | 11.2 | 3.7 | 19.4 | 64.6 | 1.1 | Homoz Pos |
| 159-fad3c | PHP38557 | AFS 6272.1.4 | 10GR13-73 | 8 | 11.2 | 3.5 | 16.7 | 67.4 | 1.2 | Homoz Pos |
| 159-fad3c | PHP38557 | AFS 6272.1.4 | 10GR13-73 | 9 | 12.3 | 3.6 | 18.0 | 64.8 | 1.3 | Homoz Pos |
| 159-fad3c | PHP38557 | AFS 6272.1.4 | 10GR13-73 | 10 | 11.1 | 3.6 | 18.2 | 66.0 | 1.1 | Homoz Pos |

TABLE 11-continued

Fatty acid profile for T2 seed analyzed from soy transformed with
PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.2.1 | 10GR13-81 | 1 | 10.4 | 2.9 | 20.6 | 58.3 | 7.8 | Null |
| 159-fad3c | PHP38557 | AFS 6272.2.1 | 10GR13-81 | 2 | 11.0 | 3.0 | 19.3 | 58.2 | 8.4 | Null |
| 159-fad3c | PHP38557 | AFS 6272.2.1 | 10GR13-82 | 1 | 12.0 | 2.9 | 12.0 | 59.3 | 13.7 | Null |
| 159-fad3c | PHP38557 | AFS 6272.2.1 | 10GR13-82 | 2 | 11.7 | 3.4 | 23.5 | 53.9 | 7.5 | Null |
| 159-fad3c | PHP38557 | AFS 6272.2.1 | 10GR13-83 | 1 | 11.8 | 3.0 | 16.7 | 67.3 | 1.2 | Homoz Pos |
| 159-fad3c | PHP38557 | AFS 6272.2.1 | 10GR13-83 | 2 | 12.1 | 3.3 | 15.2 | 68.3 | 1.1 | Homoz Pos |
| 159-fad3c | PHP38557 | AFS 6272.2.1 | 10GR13-83 | 3 | 11.2 | 3.1 | 15.6 | 68.8 | 1.3 | Homoz Pos |
| 159-fad3c | PHP38557 | AFS 6272.2.1 | 10GR13-83 | 4 | 11.6 | 3.0 | 15.6 | 68.5 | 1.3 | Homoz Pos |
| 159-fad3c | PHP38557 | AFS 6272.2.1 | 10GR13-83 | 5 | 12.0 | 3.0 | 18.4 | 65.4 | 1.1 | Homoz Pos |
| 159-fad3c | PHP38557 | AFS 6272.2.1 | 10GR13-83 | 6 | 12.2 | 3.7 | 18.1 | 64.9 | 1.0 | Homoz Pos |
| 159-fad3c | PHP38557 | AFS 6272.2.1 | 10GR13-83 | 7 | 11.6 | 3.1 | 19.0 | 65.3 | 1.0 | Homoz Pos |
| 159-fad3c | PHP38557 | AFS 6272.2.1 | 10GR13-83 | 8 | 12.0 | 3.2 | 15.1 | 68.3 | 1.4 | Homoz Pos |
| 159-fad3c | PHP38557 | AFS 6272.2.1 | 10GR13-83 | 9 | 12.1 | 3.1 | 14.0 | 69.2 | 1.6 | Homoz Pos |
| 159-fad3c | PHP38557 | AFS 6272.2.1 | 10GR13-83 | 10 | 11.7 | 3.3 | 17.0 | 67.0 | 1.1 | Homoz Pos |
| 159-fad3c | PHP38557 | AFS 6272.2.1 | 10GR13-90 | 1 | 12.6 | 3.2 | 19.8 | 63.4 | 1.0 | Homoz Pos |
| 159-fad3c | PHP38557 | AFS 6272.2.1 | 10GR13-90 | 2 | 11.8 | 3.0 | 19.0 | 64.9 | 1.3 | Homoz Pos |
| 159-fad3c | PHP38557 | AFS 6272.2.1 | 10GR13-90 | 3 | 10.5 | 2.6 | 14.8 | 70.7 | 1.4 | Homoz Pos |
| 159-fad3c | PHP38557 | AFS 6272.2.1 | 10GR13-90 | 4 | 11.2 | 3.0 | 11.9 | 72.4 | 1.5 | Homoz Pos |
| 159-fad3c | PHP38557 | AFS 6272.2.1 | 10GR13-90 | 5 | 11.1 | 2.9 | 17.9 | 67.0 | 1.2 | Homoz Pos |
| 159-fad3c | PHP38557 | AFS 6272.2.1 | 10GR13-90 | 6 | 12.0 | 2.8 | 20.1 | 64.2 | 1.0 | Homoz Pos |
| 159-fad3c | PHP38557 | AFS 6272.2.1 | 10GR13-90 | 7 | 13.6 | 3.6 | 13.1 | 68.2 | 1.5 | Homoz Pos |
| 159-fad3c | PHP38557 | AFS 6272.2.1 | 10GR13-90 | 8 | 10.8 | 2.9 | 15.9 | 69.0 | 1.4 | Homoz Pos |
| 159-fad3c | PHP38557 | AFS 6272.2.1 | 10GR13-90 | 9 | 11.9 | 2.6 | 20.3 | 64.0 | 1.2 | Homoz Pos |
| 159-fad3c | PHP38557 | AFS 6272.2.1 | 10GR13-90 | 10 | 12.3 | 3.2 | 20.7 | 62.6 | 1.2 | Homoz Pos |
| 159-fad3c | PHP38557 | AFS 6272.2.1 | 10GR13-91 | 1 | 10.8 | 3.0 | 28.2 | 57.0 | 1.0 | Homoz Pos |
| 159-fad3c | PHP38557 | AFS 6272.2.1 | 10GR13-91 | 2 | 11.1 | 3.3 | 21.3 | 63.3 | 1.1 | Homoz Pos |
| 159-fad3c | PHP38557 | AFS 6272.2.1 | 10GR13-91 | 3 | 10.9 | 2.9 | 19.3 | 65.8 | 1.2 | Homoz Pos |
| 159-fad3c | PHP38557 | AFS 6272.2.1 | 10GR13-91 | 4 | 11.0 | 3.0 | 18.5 | 66.2 | 1.2 | Homoz Pos |
| 159-fad3c | PHP38557 | AFS 6272.2.1 | 10GR13-91 | 5 | 10.9 | 2.6 | 22.4 | 62.9 | 1.2 | Homoz Pos |
| 159-fad3c | PHP38557 | AFS 6272.2.1 | 10GR13-91 | 6 | 11.1 | 3.0 | 22.2 | 62.7 | 1.0 | Homoz Pos |
| 159-fad3c | PHP38557 | AFS 6272.2.1 | 10GR13-91 | 7 | 10.4 | 3.5 | 16.5 | 68.3 | 1.3 | Homoz Pos |
| 159-fad3c | PHP38557 | AFS 6272.2.1 | 10GR13-91 | 8 | 12.0 | 3.5 | 24.1 | 59.7 | 0.8 | Homoz Pos |
| 159-fad3c | PHP38557 | AFS 6272.2.1 | 10GR13-91 | 9 | 13.8 | 3.9 | 23.2 | 58.2 | 0.9 | Homoz Pos |
| 159-fad3c | PHP38557 | AFS 6272.2.1 | 10GR13-91 | 10 | 11.7 | 2.8 | 23.9 | 60.7 | 0.9 | Homoz Pos |
| 159-fad3c | PHP38557 | AFS 6272.2.1 | 10GR13-93 | 1 | 11.6 | 2.9 | 20.8 | 63.5 | 1.1 | Homoz Pos |
| 159-fad3c | PHP38557 | AFS 6272.2.1 | 10GR13-93 | 2 | 11.2 | 2.8 | 20.2 | 64.3 | 1.5 | Homoz Pos |

TABLE 11-continued

Fatty acid profile for T2 seed analyzed from soy transformed with
PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.2.1 | 10GR13-93 | 3 | 10.3 | 3.1 | 18.6 | 66.3 | 1.7 | Homoz Pos |
| 159-fad3c | PHP38557 | AFS 6272.2.1 | 10GR13-93 | 4 | 10.8 | 2.7 | 18.3 | 66.5 | 1.7 | Homoz Pos |
| 159-fad3c | PHP38557 | AFS 6272.2.1 | 10GR13-93 | 5 | 11.2 | 2.6 | 20.0 | 64.8 | 1.4 | Homoz Pos |
| 159-fad3c | PHP38557 | AFS 6272.2.1 | 10GR13-93 | 6 | 10.2 | 2.9 | 21.8 | 63.7 | 1.4 | Homoz Pos |
| 159-fad3c | PHP38557 | AFS 6272.2.1 | 10GR13-93 | 7 | 10.8 | 2.9 | 19.5 | 65.8 | 1.1 | Homoz Pos |
| 159-fad3c | PHP38557 | AFS 6272.2.1 | 10GR13-93 | 8 | 9.9 | 2.9 | 21.8 | 64.2 | 1.3 | Homoz Pos |
| 159-fad3c | PHP38557 | AFS 6272.2.1 | 10GR13-93 | 9 | 11.2 | 2.8 | 17.9 | 66.5 | 1.7 | Homoz Pos |
| 159-fad3c | PHP38557 | AFS 6272.2.1 | 10GR13-93 | 10 | 10.5 | 2.9 | 24.5 | 60.8 | 1.3 | Homoz Pos |
| 159-fad3c | PHP38557 | AFS 6272.2.1 | 10GR13-94 | 1 | 11.1 | 2.9 | 20.7 | 64.3 | 1.0 | Homoz Pos |
| 159-fad3c | PHP38557 | AFS 6272.2.1 | 10GR13-94 | 2 | 11.4 | 3.3 | 16.0 | 68.0 | 1.3 | Homoz Pos |
| 159-fad3c | PHP38557 | AFS 6272.2.1 | 10GR13-94 | 3 | 11.0 | 3.0 | 18.5 | 66.4 | 1.1 | Homoz Pos |
| 159-fad3c | PHP38557 | AFS 6272.2.1 | 10GR13-94 | 4 | 10.9 | 3.0 | 19.5 | 65.7 | 1.0 | Homoz Pos |
| 159-fad3c | PHP38557 | AFS 6272.2.1 | 10GR13-94 | 5 | 11.4 | 2.8 | 16.3 | 68.5 | 1.2 | Homoz Pos |
| 159-fad3c | PHP38557 | AFS 6272.2.1 | 10GR13-94 | 6 | 11.2 | 3.1 | 17.7 | 66.8 | 1.1 | Homoz Pos |
| 159-fad3c | PHP38557 | AFS 6272.2.1 | 10GR13-94 | 7 | 12.0 | 3.3 | 14.3 | 68.9 | 1.4 | Homoz Pos |
| 159-fad3c | PHP38557 | AFS 6272.2.1 | 10GR13-94 | 8 | 11.4 | 2.9 | 18.8 | 65.7 | 1.1 | Homoz Pos |
| 159-fad3c | PHP38557 | AFS 6272.2.1 | 10GR13-94 | 9 | 11.4 | 3.2 | 19.7 | 64.7 | 1.1 | Homoz Pos |
| 159-fad3c | PHP38557 | AFS 6272.2.1 | 10GR13-94 | 10 | 11.6 | 3.1 | 20.0 | 64.3 | 1.0 | Homoz Pos |
| 159-fad3c | PHP38557 | AFS 6272.2.3 | 10GR13-107 | 1 | 11.0 | 3.8 | 19.5 | 58.2 | 7.6 | Null |
| 159-fad3c | PHP38557 | AFS 6272.2.3 | 10GR13-107 | 2 | 11.9 | 3.5 | 20.2 | 56.7 | 7.7 | Null |
| 159-fad3c | PHP38557 | AFS 6272.2.3 | 10GR13-109 | 1 | 11.2 | 3.3 | 16.3 | 59.7 | 9.5 | Null |
| 159-fad3c | PHP38557 | AFS 6272.2.3 | 10GR13-109 | 2 | 12.1 | 3.3 | 14.6 | 59.3 | 10.7 | Null |
| 159-fad3c | PHP38557 | AFS 6272.2.3 | 10GR13-95 | 1 | 10.9 | 2.8 | 16.7 | 68.4 | 1.2 | Homoz Pos |
| 159-fad3c | PHP38557 | AFS 6272.2.3 | 10GR13-95 | 2 | 11.8 | 3.5 | 18.7 | 65.0 | 1.0 | Homoz Pos |
| 159-fad3c | PHP38557 | AFS 6272.2.3 | 10GR13-95 | 3 | 11.7 | 3.9 | 18.6 | 64.9 | 0.9 | Homoz Pos |
| 159-fad3c | PHP38557 | AFS 6272.2.3 | 10GR13-95 | 4 | 11.3 | 2.4 | 24.0 | 61.4 | 1.0 | Homoz Pos |
| 159-fad3c | PHP38557 | AFS 6272.2.3 | 10GR13-95 | 5 | 11.9 | 2.9 | 19.3 | 64.8 | 1.0 | Homoz Pos |
| 159-fad3c | PHP38557 | AFS 6272.2.3 | 10GR13-95 | 6 | 11.7 | 2.8 | 13.9 | 70.3 | 1.3 | Homoz Pos |
| 159-fad3c | PHP38557 | AFS 6272.2.3 | 10GR13-95 | 7 | 11.4 | 3.0 | 18.2 | 66.3 | 1.2 | Homoz Pos |
| 159-fad3c | PHP38557 | AFS 6272.2.3 | 10GR13-95 | 8 | 11.8 | 3.9 | 13.6 | 69.4 | 1.4 | Homoz Pos |
| 159-fad3c | PHP38557 | AFS 6272.2.3 | 10GR13-95 | 9 | 12.5 | 2.9 | 16.9 | 66.4 | 1.3 | Homoz Pos |
| 159-fad3c | PHP38557 | AFS 6272.2.3 | 10GR13-95 | 10 | 11.0 | 2.9 | 16.7 | 68.3 | 1.1 | Homoz Pos |
| 159-fad3c | PHP38557 | AFS 6272.2.3 | 10GR13-96 | 1 | 12.6 | 3.7 | 14.6 | 66.4 | 2.8 | Homoz Pos |
| 159-fad3c | PHP38557 | AFS 6272.2.3 | 10GR13-96 | 2 | 12.4 | 3.8 | 13.0 | 68.1 | 2.7 | Homoz Pos |
| 159-fad3c | PHP38557 | AFS 6272.2.3 | 10GR13-96 | 3 | 12.3 | 3.4 | 12.9 | 69.2 | 2.2 | Homoz Pos |
| 159-fad3c | PHP38557 | AFS 6272.2.3 | 10GR13-96 | 4 | 12.9 | 3.9 | 11.9 | 67.6 | 3.7 | Homoz Pos |

TABLE 11-continued

Fatty acid profile for T2 seed analyzed from soy transformed with
PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.2.3 | 10GR13-96 | 5 | 11.9 | 3.6 | 12.9 | 69.0 | 2.7 | Homoz Pos |
| 159-fad3c | PHP38557 | AFS 6272.2.3 | 10GR13-96 | 6 | 12.2 | 3.5 | 12.6 | 67.9 | 3.8 | Homoz Pos |
| 159-fad3c | PHP38557 | AFS 6272.2.3 | 10GR13-96 | 7 | 13.1 | 4.6 | 11.5 | 66.6 | 4.2 | Homoz Pos |
| 159-fad3c | PHP38557 | AFS 6272.2.3 | 10GR13-96 | 8 | 12.7 | 3.7 | 12.7 | 68.6 | 2.3 | Homoz Pos |
| 159-fad3c | PHP38557 | AFS 6272.2.3 | 10GR13-96 | 9 | 12.9 | 3.6 | 12.3 | 68.4 | 2.7 | Homoz Pos |
| 159-fad3c | PHP38557 | AFS 6272.2.3 | 10GR13-96 | 10 | 12.0 | 3.4 | 15.9 | 66.5 | 2.3 | Homoz Pos |
| 159-fad3c | PHP38557 | AFS 6272.2.3 | 10GR13-97 | 1 | 11.6 | 3.8 | 18.9 | 64.3 | 1.5 | Homoz Pos |
| 159-fad3c | PHP38557 | AFS 6272.2.3 | 10GR13-97 | 2 | 11.4 | 3.3 | 16.2 | 67.2 | 1.9 | Homoz Pos |
| 159-fad3c | PHP38557 | AFS 6272.2.3 | 10GR13-97 | 3 | 10.8 | 3.4 | 14.8 | 69.1 | 1.9 | Homoz Pos |
| 159-fad3c | PHP38557 | AFS 6272.2.3 | 10GR13-97 | 4 | 11.6 | 3.6 | 18.2 | 64.7 | 1.9 | Homoz Pos |
| 159-fad3c | PHP38557 | AFS 6272.2.3 | 10GR13-97 | 5 | 11.8 | 3.4 | 14.8 | 67.8 | 2.2 | Homoz Pos |
| 159-fad3c | PHP38557 | AFS 6272.2.3 | 10GR13-97 | 6 | 11.1 | 3.8 | 15.6 | 67.6 | 1.9 | Homoz Pos |
| 159-fad3c | PHP38557 | AFS 6272.2.3 | 10GR13-97 | 7 | 11.6 | 3.4 | 16.2 | 66.7 | 2.1 | Homoz Pos |
| 159-fad3c | PHP38557 | AFS 6272.2.3 | 10GR13-97 | 8 | 11.8 | 3.5 | 13.3 | 69.1 | 2.3 | Homoz Pos |
| 159-fad3c | PHP38557 | AFS 6272.2.3 | 10GR13-97 | 9 | 12.4 | 3.7 | 15.0 | 66.7 | 2.2 | Homoz Pos |
| 159-fad3c | PHP38557 | AFS 6272.2.3 | 10GR13-97 | 10 | 11.8 | 3.3 | 14.6 | 68.4 | 1.9 | Homoz Pos |
| 159-fad3c | PHP38557 | AFS 6272.2.3 | 10GR13-98 | 1 | 11.6 | 3.4 | 16.7 | 66.6 | 1.7 | Homoz Pos |
| 159-fad3c | PHP38557 | AFS 6272.2.3 | 10GR13-98 | 2 | 11.2 | 3.7 | 15.5 | 67.9 | 1.7 | Homoz Pos |
| 159-fad3c | PHP38557 | AFS 6272.2.3 | 10GR13-98 | 3 | 11.7 | 3.4 | 17.1 | 66.2 | 1.6 | Homoz Pos |
| 159-fad3c | PHP38557 | AFS 6272.2.3 | 10GR13-98 | 4 | 12.2 | 3.5 | 17.2 | 65.6 | 1.4 | Homoz Pos |
| 159-fad3c | PHP38557 | AFS 6272.2.3 | 10GR13-98 | 5 | 11.8 | 3.4 | 15.2 | 67.8 | 1.7 | Homoz Pos |
| 159-fad3c | PHP38557 | AFS 6272.2.3 | 10GR13-98 | 6 | 11.9 | 3.6 | 14.9 | 67.5 | 2.1 | Homoz Pos |
| 159-fad3c | PHP38557 | AFS 6272.2.3 | 10GR13-98 | 7 | 11.4 | 3.6 | 16.1 | 67.2 | 1.8 | Homoz Pos |
| 159-fad3c | PHP38557 | AFS 6272.2.3 | 10GR13-98 | 8 | 11.7 | 3.6 | 16.6 | 66.6 | 1.5 | Homoz Pos |
| 159-fad3c | PHP38557 | AFS 6272.2.3 | 10GR13-98 | 9 | 12.0 | 3.6 | 17.7 | 65.2 | 1.5 | Homoz Pos |
| 159-fad3c | PHP38557 | AFS 6272.2.3 | 10GR13-98 | 10 | 11.7 | 3.5 | 15.1 | 67.7 | 2.0 | Homoz Pos |
| 159-fad3c | PHP38557 | AFS 6272.2.3 | 10GR13-101 | 1 | 11.3 | 3.6 | 17.5 | 66.1 | 1.6 | Homoz Pos |
| 159-fad3c | PHP38557 | AFS 6272.2.3 | 10GR13-101 | 2 | 11.8 | 3.5 | 16.3 | 66.4 | 2.0 | Homoz Pos |
| 159-fad3c | PHP38557 | AFS 6272.2.3 | 10GR13-101 | 3 | 11.2 | 3.5 | 16.7 | 66.2 | 2.4 | Homoz Pos |
| 159-fad3c | PHP38557 | AFS 6272.2.3 | 10GR13-101 | 4 | 11.3 | 3.4 | 16.8 | 66.9 | 1.6 | Homoz Pos |
| 159-fad3c | PHP38557 | AFS 6272.2.3 | 10GR13-101 | 5 | 11.8 | 3.5 | 16.6 | 66.1 | 1.9 | Homoz Pos |
| 159-fad3c | PHP38557 | AFS 6272.2.3 | 10GR13-101 | 6 | 11.8 | 3.6 | 14.0 | 68.4 | 2.3 | Homoz Pos |
| 159-fad3c | PHP38557 | AFS 6272.2.3 | 10GR13-101 | 7 | 11.6 | 3.5 | 16.2 | 66.2 | 2.5 | Homoz Pos |
| 159-fad3c | PHP38557 | AFS 6272.2.3 | 10GR13-101 | 8 | 11.5 | 3.7 | 14.9 | 67.2 | 2.7 | Homoz Pos |
| 159-fad3c | PHP38557 | AFS 6272.2.3 | 10GR13-101 | 9 | 12.0 | 3.6 | 14.6 | 66.6 | 3.1 | Homoz Pos |
| 159-fad3c | PHP38557 | AFS 6272.2.3 | 10GR13-101 | 10 | 12.2 | 3.2 | 14.6 | 68.0 | 2.0 | Homoz Pos |

TABLE 11-continued

Fatty acid profile for T2 seed analyzed from soy transformed with
PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.2.3 | 10GR13-102 | 1 | 11.4 | 3.3 | 14.9 | 67.5 | 2.9 | Homoz Pos |
| 159-fad3c | PHP38557 | AFS 6272.2.3 | 10GR13-102 | 2 | 11.2 | 3.5 | 15.8 | 67.7 | 1.8 | Homoz Pos |
| 159-fad3c | PHP38557 | AFS 6272.2.3 | 10GR13-102 | 3 | 11.1 | 3.6 | 21.6 | 61.9 | 1.9 | Homoz Pos |
| 159-fad3c | PHP38557 | AFS 6272.2.3 | 10GR13-102 | 4 | 11.2 | 3.8 | 18.6 | 64.2 | 2.2 | Homoz Pos |
| 159-fad3c | PHP38557 | AFS 6272.2.3 | 10GR13-102 | 5 | 11.1 | 3.6 | 15.8 | 67.5 | 2.0 | Homoz Pos |
| 159-fad3c | PHP38557 | AFS 6272.2.3 | 10GR13-102 | 6 | 10.6 | 3.5 | 15.3 | 68.8 | 1.9 | Homoz Pos |
| 159-fad3c | PHP38557 | AFS 6272.2.3 | 10GR13-102 | 7 | 11.2 | 3.3 | 17.6 | 66.3 | 1.6 | Homoz Pos |
| 159-fad3c | PHP38557 | AFS 6272.2.3 | 10GR13-102 | 8 | 10.8 | 3.2 | 17.9 | 65.8 | 2.2 | Homoz Pos |
| 159-fad3c | PHP38557 | AFS 6272.2.3 | 10GR13-102 | 9 | 11.6 | 3.1 | 18.4 | 65.3 | 1.5 | Homoz Pos |
| 159-fad3c | PHP38557 | AFS 6272.2.3 | 10GR13-102 | 10 | 11.6 | 3.2 | 16.5 | 66.9 | 1.8 | Homoz Pos |
| 159-fad3c | PHP38557 | AFS 6272.2.3 | 10GR13-103 | 1 | 11.4 | 3.4 | 14.4 | 68.5 | 2.2 | Homoz Pos |
| 159-fad3c | PHP38557 | AFS 6272.2.3 | 10GR13-103 | 2 | 11.1 | 3.5 | 16.2 | 67.6 | 1.6 | Homoz Pos |
| 159-fad3c | PHP38557 | AFS 6272.2.3 | 10GR13-103 | 3 | 11.6 | 3.5 | 13.7 | 67.9 | 3.3 | Homoz Pos |
| 159-fad3c | PHP38557 | AFS 6272.2.3 | 10GR13-103 | 4 | 11.2 | 3.3 | 15.6 | 68.1 | 1.9 | Homoz Pos |
| 159-fad3c | PHP38557 | AFS 6272.2.3 | 10GR13-103 | 5 | 11.7 | 3.3 | 14.1 | 67.1 | 3.8 | Homoz Pos |
| 159-fad3c | PHP38557 | AFS 6272.2.3 | 10GR13-103 | 6 | 11.0 | 3.7 | 13.9 | 68.8 | 2.6 | Homoz Pos |
| 159-fad3c | PHP38557 | AFS 6272.2.3 | 10GR13-103 | 7 | 11.0 | 3.6 | 13.5 | 68.4 | 3.5 | Homoz Pos |
| 159-fad3c | PHP38557 | AFS 6272.2.3 | 10GR13-103 | 8 | 11.4 | 3.1 | 14.8 | 67.7 | 2.9 | Homoz Pos |
| 159-fad3c | PHP38557 | AFS 6272.2.3 | 10GR13-103 | 9 | 11.5 | 3.6 | 13.9 | 67.7 | 3.3 | Homoz Pos |
| 159-fad3c | PHP38557 | AFS 6272.2.3 | 10GR13-103 | 10 | 12.1 | 3.7 | 15.1 | 66.0 | 3.1 | Homoz Pos |
| 159-fad3c | PHP38557 | AFS 6272.2.3 | 10GR13-104 | 1 | 12.3 | 3.5 | 12.5 | 68.8 | 2.9 | Homoz Pos |
| 159-fad3c | PHP38557 | AFS 6272.2.3 | 10GR13-104 | 2 | 10.9 | 3.3 | 15.2 | 68.6 | 2.0 | Homoz Pos |
| 159-fad3c | PHP38557 | AFS 6272.2.3 | 10GR13-104 | 3 | 11.3 | 3.6 | 14.0 | 68.9 | 2.3 | Homoz Pos |
| 159-fad3c | PHP38557 | AFS 6272.2.3 | 10GR13-104 | 4 | 12.2 | 3.5 | 13.3 | 67.0 | 3.9 | Homoz Pos |
| 159-fad3c | PHP38557 | AFS 6272.2.3 | 10GR13-104 | 5 | 12.8 | 3.8 | 13.2 | 66.7 | 3.4 | Homoz Pos |
| 159-fad3c | PHP38557 | AFS 6272.2.3 | 10GR13-104 | 6 | 11.0 | 3.3 | 16.1 | 67.9 | 1.7 | Homoz Pos |
| 159-fad3c | PHP38557 | AFS 6272.2.3 | 10GR13-104 | 7 | 12.6 | 3.7 | 12.2 | 67.0 | 4.4 | Homoz Pos |
| 159-fad3c | PHP38557 | AFS 6272.2.3 | 10GR13-104 | 8 | 12.2 | 3.6 | 13.0 | 68.5 | 2.7 | Homoz Pos |
| 159-fad3c | PHP38557 | AFS 6272.2.3 | 10GR13-104 | 9 | 13.2 | 3.8 | 13.3 | 65.8 | 4.0 | Homoz Pos |
| 159-fad3c | PHP38557 | AFS 6272.2.3 | 10GR13-104 | 10 | 11.4 | 3.4 | 13.2 | 68.5 | 3.5 | Homoz Pos |
| 159-fad3c | PHP38557 | AFS 6272.2.3 | 10GR13-106 | 1 | 11.4 | 3.5 | 18.5 | 64.9 | 1.8 | Homoz Pos |
| 159-fad3c | PHP38557 | AFS 6272.2.3 | 10GR13-106 | 2 | 11.4 | 3.2 | 16.7 | 66.8 | 1.9 | Homoz Pos |
| 159-fad3c | PHP38557 | AFS 6272.2.3 | 10GR13-106 | 3 | 11.1 | 3.5 | 16.3 | 67.1 | 2.1 | Homoz Pos |
| 159-fad3c | PHP38557 | AFS 6272.2.3 | 10GR13-106 | 4 | 12.0 | 3.6 | 17.8 | 64.9 | 1.7 | Homoz Pos |
| 159-fad3c | PHP38557 | AFS 6272.2.3 | 10GR13-106 | 5 | 11.5 | 3.7 | 15.0 | 67.7 | 2.0 | Homoz Pos |
| 159-fad3c | PHP38557 | AFS 6272.2.3 | 10GR13-106 | 6 | 11.0 | 3.6 | 14.3 | 69.0 | 2.1 | Homoz Pos |

TABLE 11-continued

Fatty acid profile for T2 seed analyzed from soy transformed with
PHP38557, containing the 159-fad3c amiRNA grown in the greenhouse.

| amiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad3c | PHP38557 | AFS 6272.2.3 | 10GR13-106 | 7 | 11.1 | 3.3 | 16.5 | 67.3 | 1.9 | Homoz Pos |
| 159-fad3c | PHP38557 | AFS 6272.2.3 | 10GR13-106 | 8 | 11.0 | 3.4 | 17.2 | 66.6 | 1.8 | Homoz Pos |
| 159-fad3c | PHP38557 | AFS 6272.2.3 | 10GR13-106 | 9 | 10.9 | 3.3 | 19.0 | 65.4 | 1.5 | Homoz Pos |
| 159-fad3c | PHP38557 | AFS 6272.2.3 | 10GR13-106 | 10 | 12.0 | 4.0 | 19.3 | 62.9 | 1.7 | Homoz Pos |

Table 11 shows that T2 seed from events expressing the 159-fad3c amiRNA have alpha-linolenic acid contents ranging from 0.8% to 4.4%. T2 seed from null segregant seed have alpha-linolenic contents ranging from 7.5% to 13.7% which is in the range typically observed for wild-type soybeans where alpha-linolenic acid ranges from 8.2% to 11.3% (see Table 12).

TABLE 12

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.1.4 | 10GR13-226 | 1 | 11.2 | 3.6 | 21.3 | 55.1 | 8.8 | Null |
| 159-fatBF | PHP41103 | AFS 6671.1.4 | 10GR13-226 | 2 | 11.3 | 3.4 | 19.6 | 57.0 | 8.6 | Null |
| 159-fatBF | PHP41103 | AFS 6671.1.4 | 10GR13-237 | 1 | 11.8 | 3.8 | 18.3 | 56.1 | 10.0 | Null |
| 159-fatBF | PHP41103 | AFS 6671.1.4 | 10GR13-237 | 2 | 12.6 | 4.2 | 23.7 | 51.6 | 7.9 | Null |
| 159-fatBF | PHP41103 | AFS 6671.1.4 | 10GR13-222 | 1 | 2.0 | 2.4 | 28.5 | 60.2 | 6.8 | Homoz Pos |
| 159-fatBF | PHP41103 | AFS 6671.1.4 | 10GR13-222 | 2 | 1.9 | 2.4 | 31.9 | 56.9 | 6.9 | Homoz Pos |
| 159-fatBF | PHP41103 | AFS 6671.1.4 | 10GR13-222 | 3 | 2.1 | 2.8 | 30.3 | 57.9 | 6.9 | Homoz Pos |
| 159-fatBF | PHP41103 | AFS 6671.1.4 | 10GR13-222 | 4 | 2.0 | 2.3 | 24.1 | 63.4 | 8.3 | Homoz Pos |
| 159-fatBF | PHP41103 | AFS 6671.1.4 | 10GR13-222 | 5 | 2.0 | 2.5 | 24.6 | 63.4 | 7.5 | Homoz Pos |
| 159-fatBF | PHP41103 | AFS 6671.1.4 | 10GR13-222 | 6 | 2.1 | 3.1 | 32.8 | 55.1 | 6.9 | Homoz Pos |
| 159-fatBF | PHP41103 | AFS 6671.1.4 | 10GR13-222 | 7 | 2.0 | 2.0 | 28.1 | 60.9 | 7.0 | Homoz Pos |
| 159-fatBF | PHP41103 | AFS 6671.1.4 | 10GR13-222 | 8 | 2.0 | 2.7 | 29.6 | 58.7 | 7.1 | Homoz Pos |
| 159-fatBF | PHP41103 | AFS 6671.1.4 | 10GR13-222 | 9 | 2.1 | 2.6 | 29.5 | 57.9 | 7.9 | Homoz Pos |
| 159-fatBF | PHP41103 | AFS 6671.1.4 | 10GR13-222 | 10 | 2.0 | 2.3 | 22.6 | 64.2 | 8.9 | Homoz Pos |
| 159-fatBF | PHP41103 | AFS 6671.1.4 | 10GR13-229 | 1 | 1.9 | 2.2 | 25.9 | 62.5 | 7.4 | Homoz Pos |
| 159-fatBF | PHP41103 | AFS 6671.1.4 | 10GR13-229 | 2 | 2.0 | 2.5 | 27.2 | 59.7 | 8.6 | Homoz Pos |
| 159-fatBF | PHP41103 | AFS 6671.1.4 | 10GR13-229 | 3 | 1.8 | 2.1 | 23.1 | 65.0 | 7.9 | Homoz Pos |
| 159-fatBF | PHP41103 | AFS 6671.1.4 | 10GR13-229 | 4 | 1.9 | 2.5 | 25.2 | 62.0 | 8.3 | Homoz Pos |
| 159-fatBF | PHP41103 | AFS 6671.1.4 | 10GR13-229 | 5 | 2.0 | 2.0 | 24.1 | 63.4 | 8.4 | Homoz Pos |
| 159-fatBF | PHP41103 | AFS 6671.1.4 | 10GR13-229 | 6 | 1.9 | 2.1 | 24.2 | 64.0 | 7.9 | Homoz Pos |
| 159-fatBF | PHP41103 | AFS 6671.1.4 | 10GR13-229 | 7 | 1.9 | 2.3 | 26.1 | 61.1 | 8.5 | Homoz Pos |
| 159-fatBF | PHP41103 | AFS 6671.1.4 | 10GR13-229 | 8 | 1.9 | 2.1 | 27.9 | 61.2 | 6.9 | Homoz Pos |
| 159-fatBF | PHP41103 | AFS 6671.1.4 | 10GR13-229 | 9 | 2.0 | 2.3 | 23.5 | 64.0 | 8.3 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.1.4 | 10GR13-229 | 10 | 2.0 | 2.2 | 23.6 | 64.0 | 8.2 | Homoz Pos |
| 159-fatBF | PHP41103 | AFS 6671.1.6 | 10GR13-261 | 1 | 12.1 | 3.6 | 24.4 | 52.7 | 7.3 | Null |
| 159-fatBF | PHP41103 | AFS 6671.1.6 | 10GR13-261 | 2 | 11.1 | 3.3 | 23.1 | 54.8 | 7.8 | Null |
| 159-fatBF | PHP41103 | AFS 6671.1.6 | 10GR13-262 | 1 | 11.0 | 4.5 | 34.8 | 44.6 | 5.2 | Null |
| 159-fatBF | PHP41103 | AFS 6671.1.6 | 10GR13-262 | 2 | 11.7 | 4.0 | 27.1 | 50.2 | 7.0 | Null |
| 159-fatBF | PHP41103 | AFS 6671.1.6 | 10GR13-242 | 1 | 1.9 | 2.1 | 26.8 | 61.7 | 7.5 | Homoz Pos |
| 159-fatBF | PHP41103 | AFS 6671.1.6 | 10GR13-242 | 2 | 1.9 | 2.0 | 32.2 | 56.5 | 7.3 | Homoz Pos |
| 159-fatBF | PHP41103 | AFS 6671.1.6 | 10GR13-242 | 3 | 1.8 | 2.0 | 20.8 | 65.8 | 9.6 | Homoz Pos |
| 159-fatBF | PHP41103 | AFS 6671.1.6 | 10GR13-242 | 4 | 1.8 | 2.1 | 29.7 | 58.7 | 7.6 | Homoz Pos |
| 159-fatBF | PHP41103 | AFS 6671.1.6 | 10GR13-242 | 5 | 1.9 | 2.2 | 23.3 | 63.9 | 8.7 | Homoz Pos |
| 159-fatBF | PHP41103 | AFS 6671.1.6 | 10GR13-242 | 6 | 1.8 | 2.1 | 26.9 | 60.8 | 8.4 | Homoz Pos |
| 159-fatBF | PHP41103 | AFS 6671.1.6 | 10GR13-242 | 7 | 1.7 | 1.9 | 20.7 | 65.6 | 10.1 | Homoz Pos |
| 159-fatBF | PHP41103 | AFS 6671.1.6 | 10GR13-242 | 8 | 2.0 | 2.0 | 33.1 | 55.2 | 7.7 | Homoz Pos |
| 159-fatBF | PHP41103 | AFS 6671.1.6 | 10GR13-242 | 9 | 1.9 | 2.2 | 33.0 | 55.9 | 7.0 | Homoz Pos |
| 159-fatBF | PHP41103 | AFS 6671.1.6 | 10GR13-242 | 10 | 2.0 | 2.3 | 23.6 | 63.5 | 8.6 | Homoz Pos |
| 159-fatBF | PHP41103 | AFS 6671.1.6 | 10GR13-243 | 1 | 2.0 | 2.0 | 34.9 | 54.1 | 7.0 | Homoz Pos |
| 159-fatBF | PHP41103 | AFS 6671.1.6 | 10GR13-243 | 2 | 2.1 | 2.1 | 37.7 | 50.8 | 7.2 | Homoz Pos |
| 159-fatBF | PHP41103 | AFS 6671.1.6 | 10GR13-243 | 3 | 2.0 | 2.0 | 35.7 | 52.0 | 8.3 | Homoz Pos |
| 159-fatBF | PHP41103 | AFS 6671.1.6 | 10GR13-243 | 4 | 2.0 | 2.0 | 36.3 | 52.6 | 7.2 | Homoz Pos |
| 159-fatBF | PHP41103 | AFS 6671.1.6 | 10GR13-243 | 5 | 2.0 | 2.0 | 25.6 | 62.1 | 8.4 | Homoz Pos |
| 159-fatBF | PHP41103 | AFS 6671.1.6 | 10GR13-243 | 6 | 2.1 | 2.5 | 46.6 | 42.3 | 6.5 | Homoz Pos |
| 159-fatBF | PHP41103 | AFS 6671.1.6 | 10GR13-243 | 7 | 2.0 | 1.9 | 37.9 | 51.0 | 7.2 | Homoz Pos |
| 159-fatBF | PHP41103 | AFS 6671.1.6 | 10GR13-243 | 8 | 2.0 | 2.2 | 32.5 | 55.1 | 8.3 | Homoz Pos |
| 159-fatBF | PHP41103 | AFS 6671.1.6 | 10GR13-243 | 9 | 2.1 | 2.4 | 39.0 | 49.1 | 7.5 | Homoz Pos |
| 159-fatBF | PHP41103 | AFS 6671.1.6 | 10GR13-243 | 10 | 2.0 | 2.2 | 36.8 | 52.1 | 7.0 | Homoz Pos |
| 159-fatBF | PHP41103 | AFS 6671.1.6 | 10GR13-244 | 1 | 2.0 | 1.8 | 25.4 | 61.9 | 9.0 | Homoz Pos |
| 159-fatBF | PHP41103 | AFS 6671.1.6 | 10GR13-244 | 2 | 1.9 | 2.2 | 23.3 | 64.4 | 8.2 | Homoz Pos |
| 159-fatBF | PHP41103 | AFS 6671.1.6 | 10GR13-244 | 3 | 1.9 | 1.9 | 22.9 | 65.1 | 8.2 | Homoz Pos |
| 159-fatBF | PHP41103 | AFS 6671.1.6 | 10GR13-244 | 4 | 1.9 | 1.8 | 33.4 | 55.1 | 7.7 | Homoz Pos |
| 159-fatBF | PHP41103 | AFS 6671.1.6 | 10GR13-244 | 5 | 1.9 | 1.8 | 29.4 | 60.4 | 6.5 | Homoz Pos |
| 159-fatBF | PHP41103 | AFS 6671.1.6 | 10GR13-244 | 6 | 1.9 | 2.4 | 30.3 | 58.4 | 7.1 | Homoz Pos |
| 159-fatBF | PHP41103 | AFS 6671.1.6 | 10GR13-244 | 7 | 2.0 | 2.1 | 25.3 | 62.6 | 8.1 | Homoz Pos |
| 159-fatBF | PHP41103 | AFS 6671.1.6 | 10GR13-244 | 8 | 1.9 | 1.7 | 24.0 | 64.5 | 7.8 | Homoz Pos |
| 159-fatBF | PHP41103 | AFS 6671.1.6 | 10GR13-244 | 9 | 2.0 | 2.1 | 33.8 | 55.6 | 6.6 | Homoz Pos |
| 159-fatBF | PHP41103 | AFS 6671.1.6 | 10GR13-244 | 10 | 1.9 | 1.9 | 28.1 | 60.9 | 7.2 | Homoz Pos |
| 159-fatBF | PHP41103 | AFS 6671.1.6 | 10GR13-247 | 1 | 1.8 | 2.0 | 25.0 | 62.4 | 8.7 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.1.6 | 10GR13-247 | 2 | 1.8 | 2.0 | 30.2 | 58.3 | 7.7 | Homoz Pos |
| 159-fatBF | PHP41103 | AFS 6671.1.6 | 10GR13-247 | 3 | 1.8 | 1.9 | 22.4 | 65.0 | 8.9 | Homoz Pos |
| 159-fatBF | PHP41103 | AFS 6671.1.6 | 10GR13-247 | 4 | 1.9 | 1.9 | 31.5 | 57.2 | 7.4 | Homoz Pos |
| 159-fatBF | PHP41103 | AFS 6671.1.6 | 10GR13-247 | 5 | 1.9 | 2.0 | 24.2 | 63.0 | 8.8 | Homoz Pos |
| 159-fatBF | PHP41103 | AFS 6671.1.6 | 10GR13-247 | 6 | 1.9 | 2.0 | 28.1 | 59.9 | 8.0 | Homoz Pos |
| 159-fatBF | PHP41103 | AFS 6671.1.6 | 10GR13-247 | 7 | 1.8 | 2.0 | 23.2 | 63.8 | 9.3 | Homoz Pos |
| 159-fatBF | PHP41103 | AFS 6671.1.6 | 10GR13-247 | 8 | 1.8 | 1.8 | 27.4 | 61.3 | 7.8 | Homoz Pos |
| 159-fatBF | PHP41103 | AFS 6671.1.6 | 10GR13-247 | 9 | 1.8 | 1.9 | 26.9 | 61.2 | 8.2 | Homoz Pos |
| 159-fatBF | PHP41103 | AFS 6671.1.6 | 10GR13-247 | 10 | 1.8 | 2.2 | 30.4 | 58.3 | 7.4 | Homoz Pos |
| 159-fatBF | PHP41103 | AFS 6671.1.6 | 10GR13-249 | 1 | 1.8 | 1.9 | 25.8 | 62.7 | 7.8 | Homoz Pos |
| 159-fatBF | PHP41103 | AFS 6671.1.6 | 10GR13-249 | 2 | 1.9 | 2.0 | 23.9 | 63.9 | 8.4 | Homoz Pos |
| 159-fatBF | PHP41103 | AFS 6671.1.6 | 10GR13-249 | 3 | 2.0 | 2.6 | 32.7 | 55.7 | 7.0 | Homoz Pos |
| 159-fatBF | PHP41103 | AFS 6671.1.6 | 10GR13-249 | 4 | 1.9 | 2.2 | 23.2 | 63.9 | 8.8 | Homoz Pos |
| 159-fatBF | PHP41103 | AFS 6671.1.6 | 10GR13-249 | 5 | 1.8 | 2.0 | 25.5 | 62.5 | 8.1 | Homoz Pos |
| 159-fatBF | PHP41103 | AFS 6671.1.6 | 10GR13-249 | 6 | 1.9 | 2.0 | 23.6 | 63.9 | 8.5 | Homoz Pos |
| 159-fatBF | PHP41103 | AFS 6671.1.6 | 10GR13-249 | 7 | 2.0 | 2.0 | 23.3 | 63.7 | 9.0 | Homoz Pos |
| 159-fatBF | PHP41103 | AFS 6671.1.6 | 10GR13-249 | 8 | 1.8 | 2.0 | 23.7 | 64.8 | 7.8 | Homoz Pos |
| 159-fatBF | PHP41103 | AFS 6671.1.6 | 10GR13-249 | 9 | 2.0 | 2.1 | 24.6 | 62.9 | 8.4 | Homoz Pos |
| 159-fatBF | PHP41103 | AFS 6671.1.6 | 10GR13-249 | 10 | 1.8 | 2.3 | 27.4 | 61.1 | 7.5 | Homoz Pos |
| 159-fatBF | PHP41103 | AFS 6671.1.6 | 10GR13-252 | 1 | 2.0 | 2.3 | 26.8 | 61.1 | 7.8 | Homoz Pos |
| 159-fatBF | PHP41103 | AFS 6671.1.6 | 10GR13-252 | 2 | 2.0 | 2.5 | 34.2 | 54.2 | 7.1 | Homoz Pos |
| 159-fatBF | PHP41103 | AFS 6671.1.6 | 10GR13-252 | 3 | 2.0 | 2.5 | 37.1 | 52.0 | 6.3 | Homoz Pos |
| 159-fatBF | PHP41103 | AFS 6671.1.6 | 10GR13-252 | 4 | 2.3 | 2.9 | 30.7 | 57.4 | 6.6 | Homoz Pos |
| 159-fatBF | PHP41103 | AFS 6671.1.6 | 10GR13-252 | 5 | 2.4 | 3.2 | 39.3 | 48.8 | 6.3 | Homoz Pos |
| 159-fatBF | PHP41103 | AFS 6671.1.6 | 10GR13-252 | 6 | 2.3 | 2.3 | 35.3 | 53.6 | 6.5 | Homoz Pos |
| 159-fatBF | PHP41103 | AFS 6671.1.6 | 10GR13-252 | 7 | 2.1 | 2.5 | 33.0 | 55.8 | 6.5 | Homoz Pos |
| 159-fatBF | PHP41103 | AFS 6671.1.6 | 10GR13-252 | 8 | 2.2 | 2.9 | 29.0 | 58.9 | 7.1 | Homoz Pos |
| 159-fatBF | PHP41103 | AFS 6671.1.6 | 10GR13-252 | 9 | 2.3 | 3.0 | 28.4 | 59.3 | 7.0 | Homoz Pos |
| 159-fatBF | PHP41103 | AFS 6671.1.6 | 10GR13-252 | 10 | 2.3 | 2.7 | 28.7 | 59.1 | 7.2 | Homoz Pos |
| 159-fatBF | PHP41103 | AFS 6671.1.6 | 10GR13-253 | 1 | 1.9 | 2.0 | 30.8 | 58.5 | 6.8 | Homoz Pos |
| 159-fatBF | PHP41103 | AFS 6671.1.6 | 10GR13-253 | 2 | 2.1 | 2.1 | 20.4 | 65.8 | 9.6 | Homoz Pos |
| 159-fatBF | PHP41103 | AFS 6671.1.6 | 10GR13-253 | 3 | 2.1 | 2.1 | 22.0 | 64.8 | 8.9 | Homoz Pos |
| 159-fatBF | PHP41103 | AFS 6671.1.6 | 10GR13-253 | 4 | 1.8 | 2.0 | 24.2 | 63.7 | 8.2 | Homoz Pos |
| 159-fatBF | PHP41103 | AFS 6671.1.6 | 10GR13-253 | 5 | 2.0 | 2.2 | 28.4 | 60.2 | 7.3 | Homoz Pos |
| 159-fatBF | PHP41103 | AFS 6671.1.6 | 10GR13-253 | 6 | 2.1 | 2.2 | 24.8 | 62.0 | 9.0 | Homoz Pos |
| 159-fatBF | PHP41103 | AFS 6671.1.6 | 10GR13-253 | 7 | 2.2 | 2.3 | 31.7 | 57.4 | 6.5 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.1.6 | 10GR13-253 | 8 | 1.9 | 2.1 | 29.1 | 59.3 | 7.6 | Homoz Pos |
| 159-fatBF | PHP41103 | AFS 6671.1.6 | 10GR13-253 | 9 | 2.1 | 2.4 | 34.6 | 54.7 | 6.2 | Homoz Pos |
| 159-fatBF | PHP41103 | AFS 6671.1.6 | 10GR13-253 | 10 | 2.0 | 2.0 | 26.3 | 62.4 | 7.3 | Homoz Pos |
| 159-fatBF | PHP41103 | AFS 6671.1.6 | 10GR13-256 | 1 | 2.0 | 2.1 | 23.7 | 64.1 | 8.2 | Homoz Pos |
| 159-fatBF | PHP41103 | AFS 6671.1.6 | 10GR13-256 | 2 | 2.0 | 2.1 | 27.9 | 61.1 | 6.8 | Homoz Pos |
| 159-fatBF | PHP41103 | AFS 6671.1.6 | 10GR13-256 | 3 | 2.0 | 2.1 | 22.1 | 65.4 | 8.4 | Homoz Pos |
| 159-fatBF | PHP41103 | AFS 6671.1.6 | 10GR13-256 | 4 | 2.3 | 2.2 | 16.4 | 66.9 | 12.2 | Homoz Pos |
| 159-fatBF | PHP41103 | AFS 6671.1.6 | 10GR13-256 | 5 | 2.1 | 2.1 | 30.6 | 58.6 | 6.6 | Homoz Pos |
| 159-fatBF | PHP41103 | AFS 6671.1.6 | 10GR13-256 | 6 | 2.0 | 2.2 | 24.3 | 63.6 | 7.9 | Homoz Pos |
| 159-fatBF | PHP41103 | AFS 6671.1.6 | 10GR13-256 | 7 | 2.1 | 2.3 | 17.8 | 67.4 | 10.4 | Homoz Pos |
| 159-fatBF | PHP41103 | AFS 6671.1.6 | 10GR13-256 | 8 | 1.9 | 1.7 | 16.7 | 70.3 | 9.4 | Homoz Pos |
| 159-fatBF | PHP41103 | AFS 6671.1.6 | 10GR13-256 | 9 | 2.0 | 2.1 | 22.8 | 65.4 | 7.7 | Homoz Pos |
| 159-fatBF | PHP41103 | AFS 6671.1.6 | 10GR13-256 | 10 | 2.0 | 2.2 | 29.2 | 60.3 | 6.3 | Homoz Pos |
| 159-fatBF | PHP41103 | AFS 6671.1.6 | 10GR13-258 | 1 | 2.4 | 2.0 | 23.4 | 63.3 | 8.8 | Homoz Pos |
| 159-fatBF | PHP41103 | AFS 6671.1.6 | 10GR13-258 | 2 | 2.4 | 2.0 | 21.1 | 63.7 | 10.9 | Homoz Pos |
| 159-fatBF | PHP41103 | AFS 6671.1.6 | 10GR13-258 | 3 | 1.9 | 2.5 | 31.0 | 57.8 | 6.8 | Homoz Pos |
| 159-fatBF | PHP41103 | AFS 6671.1.6 | 10GR13-258 | 4 | 2.5 | 2.0 | 21.1 | 63.6 | 10.8 | Homoz Pos |
| 159-fatBF | PHP41103 | AFS 6671.1.6 | 10GR13-258 | 5 | 2.5 | 2.0 | 28.9 | 59.6 | 7.1 | Homoz Pos |
| 159-fatBF | PHP41103 | AFS 6671.1.6 | 10GR13-258 | 6 | 2.7 | 1.9 | 17.3 | 64.5 | 13.6 | Homoz Pos |
| 159-fatBF | PHP41103 | AFS 6671.1.6 | 10GR13-258 | 7 | 2.3 | 2.3 | 35.2 | 55.2 | 5.1 | Homoz Pos |
| 159-fatBF | PHP41103 | AFS 6671.1.6 | 10GR13-258 | 8 | 2.1 | 2.4 | 32.4 | 57.0 | 6.1 | Homoz Pos |
| 159-fatBF | PHP41103 | AFS 6671.1.6 | 10GR13-258 | 9 | 2.3 | 2.8 | 28.1 | 59.4 | 7.5 | Homoz Pos |
| 159-fatBF | PHP41103 | AFS 6671.1.6 | 10GR13-258 | 10 | 2.5 | 1.9 | 26.8 | 60.5 | 8.3 | Homoz Pos |
| 159-fatBF | PHP41103 | AFS 6671.1.6 | 10GR13-260 | 1 | 2.1 | 2.1 | 26.2 | 61.8 | 7.7 | Homoz Pos |
| 159-fatBF | PHP41103 | AFS 6671.1.6 | 10GR13-260 | 2 | 1.9 | 1.9 | 33.4 | 55.2 | 7.5 | Homoz Pos |
| 159-fatBF | PHP41103 | AFS 6671.1.6 | 10GR13-260 | 3 | 2.0 | 1.7 | 32.6 | 56.6 | 7.1 | Homoz Pos |
| 159-fatBF | PHP41103 | AFS 6671.1.6 | 10GR13-260 | 4 | 2.1 | 2.1 | 24.9 | 62.5 | 8.5 | Homoz Pos |
| 159-fatBF | PHP41103 | AFS 6671.1.6 | 10GR13-260 | 5 | 2.0 | 2.0 | 29.2 | 59.8 | 7.0 | Homoz Pos |
| 159-fatBF | PHP41103 | AFS 6671.1.6 | 10GR13-260 | 6 | 2.0 | 1.9 | 26.9 | 61.3 | 7.9 | Homoz Pos |
| 159-fatBF | PHP41103 | AFS 6671.1.6 | 10GR13-260 | 7 | 1.9 | 1.8 | 24.3 | 63.7 | 8.2 | Homoz Pos |
| 159-fatBF | PHP41103 | AFS 6671.1.6 | 10GR13-260 | 8 | 2.2 | 2.2 | 28.9 | 59.4 | 7.4 | Homoz Pos |
| 159-fatBF | PHP41103 | AFS 6671.1.6 | 10GR13-260 | 9 | 1.9 | 1.9 | 34.1 | 56.1 | 5.9 | Homoz Pos |
| 159-fatBF | PHP41103 | AFS 6671.1.6 | 10GR13-260 | 10 | 2.0 | 1.9 | 31.3 | 58.1 | 6.6 | Homoz Pos |
| 159-fatBF | PHP41103 | AFS 6671.3.2 | 10GR13-269 | 1 | 11.7 | 3.7 | 21.4 | 55.6 | 7.6 | Null |
| 159-fatBF | PHP41103 | AFS 6671.3.2 | 10GR13-269 | 2 | 11.9 | 4.0 | 23.2 | 54.6 | 6.3 | Null |
| 159-fatBF | PHP41103 | AFS 6671.3.2 | 10GR13-270 | 1 | 2.1 | 2.0 | 25.7 | 62.4 | 7.7 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.3.2 | 10GR13-270 | 2 | 1.9 | 2.3 | 23.0 | 64.6 | 8.2 | Homoz Pos |
| 159-fatBF | PHP41103 | AFS 6671.3.2 | 10GR13-270 | 3 | 2.0 | 2.4 | 24.6 | 63.3 | 7.6 | Homoz Pos |
| 159-fatBF | PHP41103 | AFS 6671.3.2 | 10GR13-270 | 4 | 2.2 | 2.6 | 29.7 | 59.7 | 5.8 | Homoz Pos |
| 159-fatBF | PHP41103 | AFS 6671.3.2 | 10GR13-270 | 5 | 2.3 | 2.5 | 22.5 | 63.9 | 8.8 | Homoz Pos |
| 159-fatBF | PHP41103 | AFS 6671.3.2 | 10GR13-270 | 6 | 2.1 | 2.2 | 20.0 | 67.1 | 8.6 | Homoz Pos |
| 159-fatBF | PHP41103 | AFS 6671.3.2 | 10GR13-270 | 7 | 2.1 | 2.4 | 21.4 | 66.0 | 8.1 | Homoz Pos |
| 159-fatBF | PHP41103 | AFS 6671.3.2 | 10GR13-270 | 8 | 2.3 | 2.7 | 27.4 | 61.0 | 6.5 | Homoz Pos |
| 159-fatBF | PHP41103 | AFS 6671.3.2 | 10GR13-270 | 9 | 2.0 | 2.2 | 24.9 | 64.4 | 6.5 | Homoz Pos |
| 159-fatBF | PHP41103 | AFS 6671.3.2 | 10GR13-270 | 10 | 2.0 | 2.1 | 24.9 | 64.2 | 6.7 | Homoz Pos |
| 159-fatBF | PHP41103 | AFS 6671.3.2 | 10GR13-274 | 1 | 2.0 | 2.0 | 29.1 | 59.6 | 7.3 | Homoz Pos |
| 159-fatBF | PHP41103 | AFS 6671.3.2 | 10GR13-274 | 2 | 2.0 | 2.1 | 29.2 | 58.8 | 7.9 | Homoz Pos |
| 159-fatBF | PHP41103 | AFS 6671.3.2 | 10GR13-274 | 3 | 2.0 | 2.2 | 27.3 | 60.6 | 7.9 | Homoz Pos |
| 159-fatBF | PHP41103 | AFS 6671.3.2 | 10GR13-274 | 4 | 2.0 | 2.0 | 27.9 | 61.0 | 7.1 | Homoz Pos |
| 159-fatBF | PHP41103 | AFS 6671.3.2 | 10GR13-274 | 5 | 2.0 | 2.4 | 27.7 | 60.0 | 7.9 | Homoz Pos |
| 159-fatBF | PHP41103 | AFS 6671.3.2 | 10GR13-274 | 6 | 2.1 | 2.3 | 28.4 | 60.1 | 7.1 | Homoz Pos |
| 159-fatBF | PHP41103 | AFS 6671.3.2 | 10GR13-274 | 7 | 2.0 | 2.6 | 31.7 | 55.8 | 7.8 | Homoz Pos |
| 159-fatBF | PHP41103 | AFS 6671.3.2 | 10GR13-274 | 8 | 1.9 | 2.1 | 22.6 | 64.0 | 9.4 | Homoz Pos |
| 159-fatBF | PHP41103 | AFS 6671.3.2 | 10GR13-274 | 9 | 2.0 | 2.4 | 32.0 | 56.5 | 7.1 | Homoz Pos |
| 159-fatBF | PHP41103 | AFS 6671.3.2 | 10GR13-274 | 10 | 2.0 | 2.3 | 27.4 | 60.4 | 7.9 | Homoz Pos |
| 159-fatBF | PHP41103 | AFS 6671.3.2 | 10GR13-277 | 1 | 2.1 | 2.3 | 30.7 | 58.4 | 6.6 | Homoz Pos |
| 159-fatBF | PHP41103 | AFS 6671.3.2 | 10GR13-277 | 2 | 2.0 | 2.3 | 27.6 | 60.9 | 7.2 | Homoz Pos |
| 159-fatBF | PHP41103 | AFS 6671.3.2 | 10GR13-277 | 3 | 2.1 | 2.4 | 30.6 | 58.1 | 6.8 | Homoz Pos |
| 159-fatBF | PHP41103 | AFS 6671.3.2 | 10GR13-277 | 4 | 1.9 | 2.3 | 28.0 | 60.4 | 7.4 | Homoz Pos |
| 159-fatBF | PHP41103 | AFS 6671.3.2 | 10GR13-277 | 5 | 2.0 | 2.4 | 28.0 | 60.7 | 6.9 | Homoz Pos |
| 159-fatBF | PHP41103 | AFS 6671.3.2 | 10GR13-277 | 6 | 2.2 | 2.3 | 23.8 | 63.0 | 8.9 | Homoz Pos |
| 159-fatBF | PHP41103 | AFS 6671.3.2 | 10GR13-277 | 7 | 2.0 | 2.5 | 30.4 | 58.8 | 6.3 | Homoz Pos |
| 159-fatBF | PHP41103 | AFS 6671.3.2 | 10GR13-277 | 8 | 2.0 | 2.1 | 28.0 | 60.7 | 7.1 | Homoz Pos |
| 159-fatBF | PHP41103 | AFS 6671.3.2 | 10GR13-277 | 9 | 2.1 | 2.8 | 27.9 | 60.1 | 7.2 | Homoz Pos |
| 159-fatBF | PHP41103 | AFS 6671.3.2 | 10GR13-277 | 10 | 2.0 | 2.0 | 26.2 | 62.7 | 7.1 | Homoz Pos |
| 159-fatBF | PHP41103 | AFS 6671.3.2 | 10GR13-278 | 1 | 2.0 | 2.6 | 33.3 | 55.5 | 6.6 | Homoz Pos |
| 159-fatBF | PHP41103 | AFS 6671.3.2 | 10GR13-278 | 2 | 2.0 | 2.2 | 25.2 | 63.4 | 7.3 | Homoz Pos |
| 159-fatBF | PHP41103 | AFS 6671.3.2 | 10GR13-278 | 3 | 1.9 | 2.3 | 22.7 | 65.2 | 7.9 | Homoz Pos |
| 159-fatBF | PHP41103 | AFS 6671.3.2 | 10GR13-278 | 4 | 1.9 | 2.5 | 26.0 | 61.5 | 8.0 | Homoz Pos |
| 159-fatBF | PHP41103 | AFS 6671.3.2 | 10GR13-278 | 5 | 2.1 | 2.6 | 28.5 | 59.8 | 7.1 | Homoz Pos |
| 159-fatBF | PHP41103 | AFS 6671.3.2 | 10GR13-278 | 6 | 2.0 | 2.9 | 30.2 | 57.4 | 7.5 | Homoz Pos |
| 159-fatBF | PHP41103 | AFS 6671.3.2 | 10GR13-278 | 7 | 2.0 | 1.9 | 28.6 | 58.8 | 8.7 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.3.2 | 10GR13-278 | 8 | 2.1 | 2.3 | 27.2 | 61.1 | 7.4 | Homoz Pos |
| 159-fatBF | PHP41103 | AFS 6671.3.2 | 10GR13-278 | 9 | 2.0 | 2.3 | 29.4 | 59.4 | 6.9 | Homoz Pos |
| 159-fatBF | PHP41103 | AFS 6671.3.2 | 10GR13-278 | 10 | 2.0 | 2.3 | 25.7 | 62.3 | 7.7 | Homoz Pos |
| 159-fatBF | PHP41103 | AFS 6671.6.1 | 10GR13-286 | 1 | 11.0 | 3.5 | 20.3 | 57.8 | 7.5 | Null |
| 159-fatBF | PHP41103 | AFS 6671.6.1 | 10GR13-286 | 2 | 10.8 | 3.5 | 18.3 | 59.1 | 8.3 | Null |
| 159-fatBF | PHP41103 | AFS 6671.6.1 | 10GR13-288 | 1 | 11.5 | 3.1 | 19.1 | 58.4 | 7.9 | Null |
| 159-fatBF | PHP41103 | AFS 6671.6.1 | 10GR13-288 | 2 | 11.0 | 3.2 | 24.6 | 53.6 | 7.6 | Null |
| 159-fatBF | PHP41103 | AFS 6671.6.1 | 10GR13-289 | 1 | 1.8 | 2.4 | 18.7 | 67.2 | 9.8 | Homoz Pos |
| 159-fatBF | PHP41103 | AFS 6671.6.1 | 10GR13-289 | 2 | 1.9 | 2.5 | 27.9 | 60.1 | 7.7 | Homoz Pos |
| 159-fatBF | PHP41103 | AFS 6671.6.1 | 10GR13-289 | 3 | 1.9 | 2.4 | 21.4 | 65.6 | 8.7 | Homoz Pos |
| 159-fatBF | PHP41103 | AFS 6671.6.1 | 10GR13-289 | 4 | 1.7 | 2.1 | 21.2 | 66.3 | 8.7 | Homoz Pos |
| 159-fatBF | PHP41103 | AFS 6671.6.1 | 10GR13-289 | 5 | 1.9 | 2.2 | 22.5 | 65.5 | 7.9 | Homoz Pos |
| 159-fatBF | PHP41103 | AFS 6671.6.1 | 10GR13-289 | 6 | 1.8 | 2.1 | 26.1 | 63.2 | 6.8 | Homoz Pos |
| 159-fatBF | PHP41103 | AFS 6671.6.1 | 10GR13-289 | 7 | 1.8 | 2.3 | 25.9 | 63.3 | 6.7 | Homoz Pos |
| 159-fatBF | PHP41103 | AFS 6671.6.1 | 10GR13-289 | 8 | 2.0 | 2.7 | 19.8 | 66.2 | 9.3 | Homoz Pos |
| 159-fatBF | PHP41103 | AFS 6671.6.1 | 10GR13-289 | 9 | 1.9 | 2.5 | 20.5 | 66.4 | 8.7 | Homoz Pos |
| 159-fatBF | PHP41103 | AFS 6671.6.1 | 10GR13-289 | 10 | 1.9 | 2.3 | 22.7 | 65.4 | 7.7 | Homoz Pos |
| 159-fatBF | PHP41103 | AFS 6671.6.1 | 10GR13-292 | 1 | 2.0 | 2.4 | 23.7 | 64.6 | 7.3 | Homoz Pos |
| 159-fatBF | PHP41103 | AFS 6671.6.1 | 10GR13-292 | 2 | 2.0 | 3.4 | 33.0 | 55.3 | 6.3 | Homoz Pos |
| 159-fatBF | PHP41103 | AFS 6671.6.1 | 10GR13-292 | 3 | 1.9 | 2.6 | 22.5 | 65.3 | 7.6 | Homoz Pos |
| 159-fatBF | PHP41103 | AFS 6671.6.1 | 10GR13-292 | 4 | 2.0 | 2.5 | 21.6 | 66.4 | 7.5 | Homoz Pos |
| 159-fatBF | PHP41103 | AFS 6671.6.1 | 10GR13-292 | 5 | 2.0 | 2.6 | 21.7 | 65.5 | 8.3 | Homoz Pos |
| 159-fatBF | PHP41103 | AFS 6671.6.1 | 10GR13-292 | 6 | 2.0 | 3.0 | 20.9 | 65.4 | 8.7 | Homoz Pos |
| 159-fatBF | PHP41103 | AFS 6671.6.1 | 10GR13-292 | 7 | 2.0 | 2.3 | 25.0 | 64.1 | 6.6 | Homoz Pos |
| 159-fatBF | PHP41103 | AFS 6671.6.1 | 10GR13-292 | 8 | 2.1 | 2.7 | 25.7 | 63.3 | 6.2 | Homoz Pos |
| 159-fatBF | PHP41103 | AFS 6671.6.1 | 10GR13-292 | 9 | 2.3 | 3.1 | 25.6 | 61.9 | 7.0 | Homoz Pos |
| 159-fatBF | PHP41103 | AFS 6671.6.1 | 10GR13-292 | 10 | 2.2 | 3.1 | 27.0 | 61.7 | 6.1 | Homoz Pos |
| 159-fatBF | PHP41103 | AFS 6671.6.1 | 10GR13-304 | 1 | 1.9 | 2.1 | 23.7 | 65.0 | 7.2 | Homoz Pos |
| 159-fatBF | PHP41103 | AFS 6671.6.1 | 10GR13-304 | 2 | 1.9 | 2.4 | 31.5 | 57.9 | 6.4 | Homoz Pos |
| 159-fatBF | PHP41103 | AFS 6671.6.1 | 10GR13-304 | 3 | 1.9 | 2.2 | 27.7 | 60.8 | 7.4 | Homoz Pos |
| 159-fatBF | PHP41103 | AFS 6671.6.1 | 10GR13-304 | 4 | 1.9 | 2.3 | 27.6 | 61.2 | 7.0 | Homoz Pos |
| 159-fatBF | PHP41103 | AFS 6671.6.1 | 10GR13-304 | 5 | 2.0 | 2.0 | 21.5 | 66.0 | 8.5 | Homoz Pos |
| 159-fatBF | PHP41103 | AFS 6671.6.1 | 10GR13-304 | 6 | 2.0 | 2.3 | 24.9 | 63.5 | 7.3 | Homoz Pos |
| 159-fatBF | PHP41103 | AFS 6671.6.1 | 10GR13-304 | 7 | 1.9 | 2.5 | 39.4 | 49.9 | 6.4 | Homoz Pos |
| 159-fatBF | PHP41103 | AFS 6671.6.1 | 10GR13-304 | 8 | 1.9 | 2.2 | 23.4 | 65.2 | 7.3 | Homoz Pos |
| 159-fatBF | PHP41103 | AFS 6671.6.1 | 10GR13-304 | 9 | 1.9 | 2.2 | 27.3 | 61.3 | 7.3 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.6.1 | 10GR13-304 | 10 | 2.0 | 2.1 | 34.2 | 55.5 | 6.3 | Homoz Pos |
| 159-fatBF | PHP41103 | AFS 6671.6.3 | 10GR13-309 | 1 | 11.7 | 3.3 | 20.2 | 57.7 | 7.1 | Null |
| 159-fatBF | PHP41103 | AFS 6671.6.3 | 10GR13-309 | 2 | 10.6 | 3.5 | 24.3 | 54.0 | 7.6 | Null |
| 159-fatBF | PHP41103 | AFS 6671.6.3 | 10GR13-318 | 1 | 12.4 | 3.1 | 21.5 | 55.1 | 7.9 | Null |
| 159-fatBF | PHP41103 | AFS 6671.6.3 | 10GR13-318 | 2 | 12.8 | 3.4 | 21.5 | 54.0 | 8.3 | Null |
| 159-fatBF | PHP41103 | AFS 6671.6.3 | 10GR13-307 | 1 | 3.0 | 2.6 | 19.8 | 65.3 | 9.3 | Homoz Pos |
| 159-fatBF | PHP41103 | AFS 6671.6.3 | 10GR13-307 | 2 | 2.7 | 2.3 | 23.5 | 63.0 | 8.4 | Homoz Pos |
| 159-fatBF | PHP41103 | AFS 6671.6.3 | 10GR13-307 | 3 | 2.7 | 2.7 | 23.3 | 62.8 | 8.5 | Homoz Pos |
| 159-fatBF | PHP41103 | AFS 6671.6.3 | 10GR13-307 | 4 | 2.6 | 2.4 | 28.0 | 60.1 | 6.9 | Homoz Pos |
| 159-fatBF | PHP41103 | AFS 6671.6.3 | 10GR13-307 | 5 | 2.8 | 2.5 | 20.9 | 65.8 | 8.0 | Homoz Pos |
| 159-fatBF | PHP41103 | AFS 6671.6.3 | 10GR13-307 | 6 | 2.9 | 2.8 | 22.5 | 63.4 | 8.4 | Homoz Pos |
| 159-fatBF | PHP41103 | AFS 6671.6.3 | 10GR13-307 | 7 | 2.6 | 2.7 | 25.3 | 61.9 | 7.6 | Homoz Pos |
| 159-fatBF | PHP41103 | AFS 6671.6.3 | 10GR13-307 | 8 | 2.6 | 2.4 | 27.6 | 60.3 | 7.1 | Homoz Pos |
| 159-fatBF | PHP41103 | AFS 6671.6.3 | 10GR13-307 | 9 | 2.6 | 2.5 | 25.2 | 61.9 | 7.8 | Homoz Pos |
| 159-fatBF | PHP41103 | AFS 6671.6.3 | 10GR13-307 | 10 | 2.4 | 2.7 | 21.9 | 66.1 | 6.9 | Homoz Pos |
| 159-fatBF | PHP41103 | AFS 6671.6.3 | 10GR13-310 | 1 | 2.8 | 2.7 | 20.5 | 65.3 | 8.8 | Homoz Pos |
| 159-fatBF | PHP41103 | AFS 6671.6.3 | 10GR13-310 | 2 | 2.7 | 2.4 | 27.8 | 60.2 | 6.9 | Homoz Pos |
| 159-fatBF | PHP41103 | AFS 6671.6.3 | 10GR13-310 | 3 | 2.5 | 2.5 | 28.9 | 59.7 | 6.4 | Homoz Pos |
| 159-fatBF | PHP41103 | AFS 6671.6.3 | 10GR13-310 | 4 | 2.8 | 2.4 | 22.5 | 64.7 | 7.6 | Homoz Pos |
| 159-fatBF | PHP41103 | AFS 6671.6.3 | 10GR13-310 | 5 | 2.6 | 2.3 | 29.8 | 59.0 | 6.2 | Homoz Pos |
| 159-fatBF | PHP41103 | AFS 6671.6.3 | 10GR13-310 | 6 | 2.5 | 2.4 | 37.0 | 52.2 | 6.0 | Homoz Pos |
| 159-fatBF | PHP41103 | AFS 6671.6.3 | 10GR13-310 | 7 | 2.6 | 2.2 | 27.2 | 60.9 | 7.2 | Homoz Pos |
| 159-fatBF | PHP41103 | AFS 6671.6.3 | 10GR13-310 | 8 | 2.3 | 2.6 | 30.0 | 58.6 | 6.5 | Homoz Pos |
| 159-fatBF | PHP41103 | AFS 6671.6.3 | 10GR13-310 | 9 | 2.6 | 2.2 | 26.6 | 61.6 | 7.1 | Homoz Pos |
| 159-fatBF | PHP41103 | AFS 6671.6.3 | 10GR13-310 | 10 | 2.3 | 2.4 | 26.0 | 61.6 | 7.7 | Homoz Pos |
| 159-fatBF | PHP41103 | AFS 6671.6.3 | 10GR13-313 | 1 | 2.5 | 2.0 | 28.7 | 59.5 | 7.4 | Homoz Pos |
| 159-fatBF | PHP41103 | AFS 6671.6.3 | 10GR13-313 | 2 | 2.6 | 2.9 | 30.7 | 57.3 | 6.5 | Homoz Pos |
| 159-fatBF | PHP41103 | AFS 6671.6.3 | 10GR13-313 | 3 | 2.4 | 2.0 | 30.1 | 59.0 | 6.4 | Homoz Pos |
| 159-fatBF | PHP41103 | AFS 6671.6.3 | 10GR13-313 | 4 | 2.3 | 2.3 | 29.4 | 59.1 | 6.9 | Homoz Pos |
| 159-fatBF | PHP41103 | AFS 6671.6.3 | 10GR13-313 | 5 | 2.4 | 1.9 | 29.4 | 60.1 | 6.2 | Homoz Pos |
| 159-fatBF | PHP41103 | AFS 6671.6.3 | 10GR13-313 | 6 | 2.2 | 2.4 | 33.1 | 56.2 | 6.1 | Homoz Pos |
| 159-fatBF | PHP41103 | AFS 6671.6.3 | 10GR13-313 | 7 | 2.4 | 2.2 | 31.8 | 56.8 | 6.8 | Homoz Pos |
| 159-fatBF | PHP41103 | AFS 6671.6.3 | 10GR13-313 | 8 | 2.1 | 2.1 | 30.2 | 59.8 | 5.8 | Homoz Pos |
| 159-fatBF | PHP41103 | AFS 6671.6.3 | 10GR13-313 | 9 | 2.4 | 2.2 | 31.9 | 57.2 | 6.4 | Homoz Pos |
| 159-fatBF | PHP41103 | AFS 6671.6.3 | 10GR13-313 | 10 | 2.2 | 2.2 | 32.6 | 56.5 | 6.5 | Homoz Pos |
| 159-fatBF | PHP41103 | AFS 6671.6.3 | 10GR13-321 | 1 | 2.5 | 2.3 | 29.2 | 59.0 | 7.0 | Homoz Pos |

TABLE 12-continued

Fatty acid profile for T2 seed analyzed from soy transformed with PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.6.3 | 10GR13-321 | 2 | 2.0 | 2.1 | 25.5 | 62.1 | 8.3 | Homoz Pos |
| 159-fatBF | PHP41103 | AFS 6671.6.3 | 10GR13-321 | 3 | 2.4 | 2.1 | 23.0 | 64.8 | 7.7 | Homoz Pos |
| 159-fatBF | PHP41103 | AFS 6671.6.3 | 10GR13-321 | 4 | 2.2 | 2.1 | 24.7 | 63.6 | 7.3 | Homoz Pos |
| 159-fatBF | PHP41103 | AFS 6671.6.3 | 10GR13-321 | 5 | 2.4 | 2.6 | 25.6 | 62.2 | 7.2 | Homoz Pos |
| 159-fatBF | PHP41103 | AFS 6671.6.3 | 10GR13-321 | 6 | 2.6 | 2.2 | 23.0 | 63.4 | 8.8 | Homoz Pos |
| 159-fatBF | PHP41103 | AFS 6671.6.3 | 10GR13-321 | 7 | 2.7 | 2.2 | 25.3 | 61.6 | 8.2 | Homoz Pos |
| 159-fatBF | PHP41103 | AFS 6671.6.3 | 10GR13-321 | 8 | 2.5 | 2.1 | 24.2 | 62.9 | 8.3 | Homoz Pos |
| 159-fatBF | PHP41103 | AFS 6671.6.3 | 10GR13-321 | 9 | 2.6 | 2.1 | 22.7 | 64.4 | 8.2 | Homoz Pos |
| 159-fatBF | PHP41103 | AFS 6671.6.3 | 10GR13-321 | 10 | 2.2 | 2.3 | 27.8 | 59.9 | 7.7 | Homoz Pos |
| 159-fatBF | PHP41103 | AFS 6671.11.2 | 10GR13-328 | 1 | 10.7 | 3.5 | 21.2 | 56.0 | 8.5 | Null |
| 159-fatBF | PHP41103 | AFS 6671.11.2 | 10GR13-328 | 2 | 10.1 | 4.0 | 24.3 | 54.4 | 7.2 | Null |
| 159-fatBF | PHP41103 | AFS 6671.11.2 | 10GR13-329 | 1 | 11.6 | 4.0 | 17.7 | 57.8 | 9.0 | Null |
| 159-fatBF | PHP41103 | AFS 6671.11.2 | 10GR13-329 | 2 | 11.5 | 3.9 | 17.2 | 57.9 | 9.6 | Null |
| 159-fatBF | PHP41103 | AFS 6671.11.2 | 10GR13-330 | 1 | 11.5 | 3.7 | 16.2 | 59.1 | 9.5 | Null |
| 159-fatBF | PHP41103 | AFS 6671.11.2 | 10GR13-330 | 2 | 11.8 | 3.7 | 15.9 | 59.1 | 9.5 | Null |
| 159-fatBF | PHP41103 | AFS 6671.11.2 | 10GR13-331 | 1 | 2.3 | 2.5 | 30.2 | 57.0 | 7.9 | Homoz Pos |
| 159-fatBF | PHP41103 | AFS 6671.11.2 | 10GR13-331 | 2 | 2.0 | 2.3 | 30.0 | 58.7 | 6.9 | Homoz Pos |
| 159-fatBF | PHP41103 | AFS 6671.11.2 | 10GR13-331 | 3 | 2.3 | 2.4 | 26.7 | 61.1 | 7.4 | Homoz Pos |
| 159-fatBF | PHP41103 | AFS 6671.11.2 | 10GR13-331 | 4 | 2.3 | 2.2 | 32.7 | 56.5 | 6.3 | Homoz Pos |
| 159-fatBF | PHP41103 | AFS 6671.11.2 | 10GR13-331 | 5 | 2.2 | 2.4 | 28.1 | 59.6 | 7.6 | Homoz Pos |
| 159-fatBF | PHP41103 | AFS 6671.11.2 | 10GR13-331 | 6 | 2.3 | 2.4 | 26.1 | 61.6 | 7.6 | Homoz Pos |
| 159-fatBF | PHP41103 | AFS 6671.11.2 | 10GR13-331 | 7 | 2.3 | 2.1 | 29.3 | 59.6 | 6.7 | Homoz Pos |
| 159-fatBF | PHP41103 | AFS 6671.11.2 | 10GR13-331 | 8 | 1.9 | 2.1 | 24.2 | 63.1 | 8.7 | Homoz Pos |
| 159-fatBF | PHP41103 | AFS 6671.11.2 | 10GR13-331 | 9 | 2.2 | 2.3 | 29.3 | 59.2 | 6.9 | Homoz Pos |
| 159-fatBF | PHP41103 | AFS 6671.11.2 | 10GR13-331 | 10 | 2.5 | 2.3 | 20.4 | 64.8 | 10.1 | Homoz Pos |
| 159-fatBF | PHP41103 | AFS 6671.11.2 | 10GR13-333 | 1 | 2.2 | 2.4 | 32.0 | 55.5 | 7.8 | Homoz Pos |
| 159-fatBF | PHP41103 | AFS 6671.11.2 | 10GR13-333 | 2 | 1.8 | 2.2 | 28.8 | 59.7 | 7.5 | Homoz Pos |
| 159-fatBF | PHP41103 | AFS 6671.11.2 | 10GR13-333 | 3 | 2.3 | 2.4 | 29.3 | 58.1 | 7.9 | Homoz Pos |
| 159-fatBF | PHP41103 | AFS 6671.11.2 | 10GR13-333 | 4 | 2.1 | 2.5 | 23.7 | 63.0 | 8.8 | Homoz Pos |
| 159-fatBF | PHP41103 | AFS 6671.11.2 | 10GR13-333 | 5 | 2.1 | 2.4 | 26.1 | 61.8 | 7.5 | Homoz Pos |
| 159-fatBF | PHP41103 | AFS 6671.11.2 | 10GR13-333 | 6 | 2.2 | 2.9 | 23.2 | 63.9 | 7.8 | Homoz Pos |
| 159-fatBF | PHP41103 | AFS 6671.11.2 | 10GR13-333 | 7 | 2.1 | 2.3 | 27.4 | 60.4 | 7.8 | Homoz Pos |
| 159-fatBF | PHP41103 | AFS 6671.11.2 | 10GR13-333 | 8 | 1.9 | 2.1 | 26.3 | 61.7 | 7.9 | Homoz Pos |
| 159-fatBF | PHP41103 | AFS 6671.11.2 | 10GR13-333 | 9 | 2.1 | 2.6 | 27.0 | 61.6 | 6.8 | Homoz Pos |
| 159-fatBF | PHP41103 | AFS 6671.11.2 | 10GR13-333 | 10 | 2.1 | 2.4 | 27.0 | 60.5 | 8.0 | Homoz Pos |
| 159-fatBF | PHP41103 | AFS 6671.11.2 | 10GR13-334 | 1 | 2.1 | 2.5 | 22.6 | 65.0 | 7.9 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.11.2 | 10GR13-334 | 2 | 2.0 | 2.7 | 24.0 | 62.9 | 8.4 | Homoz Pos |
| 159-fatBF | PHP41103 | AFS 6671.11.2 | 10GR13-334 | 3 | 2.1 | 2.5 | 26.6 | 61.0 | 7.8 | Homoz Pos |
| 159-fatBF | PHP41103 | AFS 6671.11.2 | 10GR13-334 | 4 | 2.2 | 2.5 | 26.6 | 60.8 | 7.8 | Homoz Pos |
| 159-fatBF | PHP41103 | AFS 6671.11.2 | 10GR13-334 | 5 | 2.0 | 2.6 | 22.7 | 64.1 | 8.5 | Homoz Pos |
| 159-fatBF | PHP41103 | AFS 6671.11.2 | 10GR13-334 | 6 | 2.1 | 2.3 | 22.7 | 65.0 | 8.0 | Homoz Pos |
| 159-fatBF | PHP41103 | AFS 6671.11.2 | 10GR13-334 | 7 | 2.1 | 2.6 | 26.5 | 61.1 | 7.7 | Homoz Pos |
| 159-fatBF | PHP41103 | AFS 6671.11.2 | 10GR13-334 | 8 | 2.2 | 2.6 | 22.7 | 63.7 | 8.8 | Homoz Pos |
| 159-fatBF | PHP41103 | AFS 6671.11.2 | 10GR13-334 | 9 | 2.1 | 2.6 | 26.1 | 60.7 | 8.6 | Homoz Pos |
| 159-fatBF | PHP41103 | AFS 6671.11.2 | 10GR13-334 | 10 | 2.1 | 3.4 | 30.5 | 56.7 | 7.3 | Homoz Pos |
| 159-fatBF | PHP41103 | AFS 6671.11.2 | 10GR13-341 | 1 | 2.2 | 2.3 | 38.1 | 50.9 | 6.4 | Homoz Pos |
| 159-fatBF | PHP41103 | AFS 6671.11.2 | 10GR13-341 | 2 | 2.2 | 3.9 | 31.1 | 56.5 | 6.4 | Homoz Pos |
| 159-fatBF | PHP41103 | AFS 6671.11.2 | 10GR13-341 | 3 | 2.3 | 3.3 | 33.6 | 54.1 | 6.7 | Homoz Pos |
| 159-fatBF | PHP41103 | AFS 6671.11.2 | 10GR13-341 | 4 | 2.3 | 2.6 | 26.2 | 61.0 | 7.8 | Homoz Pos |
| 159-fatBF | PHP41103 | AFS 6671.11.2 | 10GR13-341 | 5 | 2.3 | 2.9 | 33.3 | 54.5 | 6.9 | Homoz Pos |
| 159-fatBF | PHP41103 | AFS 6671.11.2 | 10GR13-341 | 6 | 2.0 | 2.6 | 41.1 | 48.0 | 6.4 | Homoz Pos |
| 159-fatBF | PHP41103 | AFS 6671.11.2 | 10GR13-341 | 7 | 2.3 | 3.3 | 31.8 | 55.8 | 6.7 | Homoz Pos |
| 159-fatBF | PHP41103 | AFS 6671.11.2 | 10GR13-341 | 8 | 2.3 | 3.3 | 31.2 | 55.9 | 7.4 | Homoz Pos |
| 159-fatBF | PHP41103 | AFS 6671.11.2 | 10GR13-341 | 9 | 2.4 | 3.1 | 36.9 | 50.9 | 6.6 | Homoz Pos |
| 159-fatBF | PHP41103 | AFS 6671.11.2 | 10GR13-341 | 10 | 2.3 | 3.0 | 34.0 | 52.7 | 8.1 | Homoz Pos |
| 159-fatBF | PHP41103 | AFS 6671.11.3 | 10GR13-353 | 1 | 11.3 | 3.1 | 23.3 | 54.5 | 7.8 | Null |
| 159-fatBF | PHP41103 | AFS 6671.11.3 | 10GR13-353 | 2 | 10.8 | 3.3 | 19.8 | 57.7 | 8.4 | Null |
| 159-fatBF | PHP41103 | AFS 6671.11.3 | 10GR13-359 | 1 | 11.4 | 3.3 | 21.0 | 56.1 | 8.2 | Null |
| 159-fatBF | PHP41103 | AFS 6671.11.3 | 10GR13-359 | 2 | 12.0 | 3.5 | 18.0 | 57.1 | 9.4 | Null |
| 159-fatBF | PHP41103 | AFS 6671.11.3 | 10GR13-347 | 1 | 2.1 | 1.9 | 27.0 | 61.1 | 7.7 | Homoz Pos |
| 159-fatBF | PHP41103 | AFS 6671.11.3 | 10GR13-347 | 2 | 1.9 | 2.5 | 25.9 | 61.6 | 8.1 | Homoz Pos |
| 159-fatBF | PHP41103 | AFS 6671.11.3 | 10GR13-347 | 3 | 2.1 | 2.1 | 22.9 | 64.1 | 8.8 | Homoz Pos |
| 159-fatBF | PHP41103 | AFS 6671.11.3 | 10GR13-347 | 4 | 2.0 | 2.0 | 23.7 | 64.5 | 7.7 | Homoz Pos |
| 159-fatBF | PHP41103 | AFS 6671.11.3 | 10GR13-347 | 5 | 2.0 | 2.2 | 23.6 | 63.1 | 9.1 | Homoz Pos |
| 159-fatBF | PHP41103 | AFS 6671.11.3 | 10GR13-347 | 6 | 2.0 | 2.2 | 22.7 | 64.5 | 8.6 | Homoz Pos |
| 159-fatBF | PHP41103 | AFS 6671.11.3 | 10GR13-347 | 7 | 2.0 | 2.1 | 25.1 | 61.9 | 8.9 | Homoz Pos |
| 159-fatBF | PHP41103 | AFS 6671.11.3 | 10GR13-347 | 8 | 2.0 | 2.2 | 27.5 | 59.9 | 8.4 | Homoz Pos |
| 159-fatBF | PHP41103 | AFS 6671.11.3 | 10GR13-347 | 9 | 2.0 | 2.1 | 26.7 | 61.2 | 8.0 | Homoz Pos |
| 159-fatBF | PHP41103 | AFS 6671.11.3 | 10GR13-347 | 10 | 1.9 | 2.3 | 24.6 | 62.8 | 8.5 | Homoz Pos |
| 159-fatBF | PHP41103 | AFS 6671.11.3 | 10GR13-355 | 1 | 2.0 | 2.4 | 29.4 | 58.2 | 8.0 | Homoz Pos |
| 159-fatBF | PHP41103 | AFS 6671.11.3 | 10GR13-355 | 2 | 1.9 | 2.3 | 24.5 | 63.1 | 8.2 | Homoz Pos |
| 159-fatBF | PHP41103 | AFS 6671.11.3 | 10GR13-355 | 3 | 2.0 | 2.4 | 27.3 | 60.3 | 8.0 | Homoz Pos |

TABLE 12-continued

Fatty acid profile for T2 seed analyzed from soy transformed with
PHP41103, containing the 159-fatBF amiRNA, grown in the greenhouse.

| amiRNA | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fatBF | PHP41103 | AFS 6671.11.3 | 10GR13-355 | 4 | 2.1 | 2.4 | 31.9 | 56.7 | 6.9 | Homoz Pos |
| 159-fatBF | PHP41103 | AFS 6671.11.3 | 10GR13-355 | 5 | 2.1 | 2.1 | 25.5 | 62.2 | 8.1 | Homoz Pos |
| 159-fatBF | PHP41103 | AFS 6671.11.3 | 10GR13-355 | 6 | 2.2 | 2.6 | 25.0 | 63.0 | 7.1 | Homoz Pos |
| 159-fatBF | PHP41103 | AFS 6671.11.3 | 10GR13-355 | 7 | 2.1 | 2.2 | 27.6 | 61.7 | 6.4 | Homoz Pos |
| 159-fatBF | PHP41103 | AFS 6671.11.3 | 10GR13-355 | 8 | 2.3 | 2.1 | 29.6 | 59.4 | 6.6 | Homoz Pos |
| 159-fatBF | PHP41103 | AFS 6671.11.3 | 10GR13-355 | 9 | 2.1 | 2.3 | 22.3 | 64.7 | 8.6 | Homoz Pos |
| 159-fatBF | PHP41103 | AFS 6671.11.3 | 10GR13-355 | 10 | 2.4 | 2.8 | 26.5 | 61.2 | 7.1 | Homoz Pos |
| 159-fatBF | PHP41103 | AFS 6671.11.3 | 10GR13-360 | 1 | 2.2 | 2.4 | 27.4 | 60.7 | 7.3 | Homoz Pos |
| 159-fatBF | PHP41103 | AFS 6671.11.3 | 10GR13-360 | 2 | 1.8 | 2.6 | 24.6 | 63.1 | 7.8 | Homoz Pos |
| 159-fatBF | PHP41103 | AFS 6671.11.3 | 10GR13-360 | 3 | 2.2 | 2.3 | 29.9 | 58.2 | 7.4 | Homoz Pos |
| 159-fatBF | PHP41103 | AFS 6671.11.3 | 10GR13-360 | 4 | 1.8 | 2.4 | 27.0 | 61.6 | 7.2 | Homoz Pos |
| 159-fatBF | PHP41103 | AFS 6671.11.3 | 10GR13-360 | 5 | 2.1 | 2.8 | 24.6 | 63.7 | 6.8 | Homoz Pos |
| 159-fatBF | PHP41103 | AFS 6671.11.3 | 10GR13-360 | 6 | 2.4 | 2.3 | 21.5 | 66.0 | 7.7 | Homoz Pos |
| 159-fatBF | PHP41103 | AFS 6671.11.3 | 10GR13-360 | 7 | 2.2 | 2.4 | 25.9 | 61.2 | 8.3 | Homoz Pos |
| 159-fatBF | PHP41103 | AFS 6671.11.3 | 10GR13-360 | 8 | 2.1 | 2.7 | 19.8 | 65.1 | 10.3 | Homoz Pos |
| 159-fatBF | PHP41103 | AFS 6671.11.3 | 10GR13-360 | 9 | 2.0 | 2.4 | 24.7 | 62.3 | 8.6 | Homoz Pos |
| 159-fatBF | PHP41103 | AFS 6671.11.3 | 10GR13-360 | 10 | 2.0 | 2.2 | 28.0 | 60.1 | 7.7 | Homoz Pos |
| 159-fatBF | PHP41103 | AFS 6671.11.3 | 10GR13-367 | 1 | 2.1 | 2.4 | 27.2 | 60.9 | 7.3 | Homoz Pos |
| 159-fatBF | PHP41103 | AFS 6671.11.3 | 10GR13-367 | 2 | 2.3 | 2.8 | 36.7 | 51.9 | 6.3 | Homoz Pos |
| 159-fatBF | PHP41103 | AFS 6671.11.3 | 10GR13-367 | 3 | 2.1 | 2.7 | 28.8 | 59.1 | 7.2 | Homoz Pos |
| 159-fatBF | PHP41103 | AFS 6671.11.3 | 10GR13-367 | 4 | 1.8 | 2.1 | 29.8 | 59.8 | 6.5 | Homoz Pos |
| 159-fatBF | PHP41103 | AFS 6671.11.3 | 10GR13-367 | 5 | 2.1 | 2.5 | 30.3 | 58.8 | 6.3 | Homoz Pos |
| 159-fatBF | PHP41103 | AFS 6671.11.3 | 10GR13-367 | 6 | 2.3 | 2.6 | 35.4 | 53.0 | 6.7 | Homoz Pos |
| 159-fatBF | PHP41103 | AFS 6671.11.3 | 10GR13-367 | 7 | 2.3 | 2.7 | 31.2 | 57.0 | 6.8 | Homoz Pos |
| 159-fatBF | PHP41103 | AFS 6671.11.3 | 10GR13-367 | 8 | 2.0 | 2.5 | 28.9 | 60.1 | 6.5 | Homoz Pos |
| 159-fatBF | PHP41103 | AFS 6671.11.3 | 10GR13-367 | 9 | 2.3 | 2.4 | 30.7 | 57.6 | 7.1 | Homoz Pos |
| 159-fatBF | PHP41103 | AFS 6671.11.3 | 10GR13-367 | 10 | 2.2 | 2.2 | 30.0 | 58.6 | 6.9 | Homoz Pos |
| | | Jack | 10GR13-61 | 1 | 12.5 | 4.3 | 14.5 | 58.3 | 10.3 | |
| | | | 10GR13-61 | 2 | 12.6 | 3.9 | 14.8 | 58.5 | 10.1 | |
| | | | 10GR13-62 | 1 | 12.3 | 3.9 | 17.9 | 57.7 | 8.2 | |
| | | | 10GR13-62 | 2 | 12.1 | 3.9 | 15.8 | 59.0 | 9.2 | |
| | | | 10GR13-111 | 1 | 11.8 | 4.0 | 13.9 | 60.5 | 9.7 | |
| | | | 10GR13-111 | 2 | 12.0 | 3.7 | 12.7 | 60.4 | 11.3 | |
| | | | 10GR13-112 | 1 | 12.3 | 3.9 | 15.7 | 59.2 | 8.8 | |
| | | | 10GR13-112 | 2 | 12.0 | 3.8 | 15.4 | 59.4 | 9.4 | |

Table 12 shows that T2 seed from events expressing the 159-fatBF amiRNA have palmitic acid contents ranging from 1.7% to 3.0%. T2 seed from null segregant seed have palmitic acid contents ranging from 10.1% to 12.8% which is in the range typically observed for Jack seed where palmitic acid ranges from 11.8% to 12.6%.

TABLE 13

Fatty acid profile for T2 seed analyzed from soy transformed with PHP41784, containing the 159-fad2-1b & 159-fatBF& 159-fad3c amiRNAs, grown in the greenhouse.

| AmiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.1.1 | 10GR32-43 | 1 | 11.1 | 2.8 | 16.9 | 57.6 | 11.7 | Null |
| 159-fad2-1b/159-fatBf/159-fad3c | PHP41784A | AFS 6784.1.1 | 10GR32-43 | 2 | 11.1 | 3.2 | 17.8 | 57.0 | 10.9 | Null |
| 159-fad2-1b/159-fatBf/159-fad3c | PHP41784A | AFS 6784.1.1 | 10GR32-47 | 1 | 2.0 | 2.5 | 89.6 | 3.7 | 2.2 | Homoz Pos |
| 159-fad2-1b/159-fatBf/159-fad3c | PHP41784A | AFS 6784.1.1 | 10GR32-47 | 2 | 2.1 | 2.8 | 88.9 | 3.6 | 2.6 | Homoz Pos |
| 159-fad2-1b/159-fatBf/159-fad3c | PHP41784A | AFS 6784.1.1 | 10GR32-47 | 3 | 1.9 | 2.4 | 89.5 | 3.7 | 2.5 | Homoz Pos |
| 159-fad2-1b/159-fatBf/159-fad3c | PHP41784A | AFS 6784.1.1 | 10GR32-47 | 4 | 2.0 | 2.5 | 88.6 | 3.7 | 3.1 | Homoz Pos |
| 159-fad2-1b/159-fatBf/159-fad3c | PHP41784A | AFS 6784.1.1 | 10GR32-47 | 5 | 1.9 | 2.6 | 89.6 | 3.6 | 2.4 | Homoz Pos |
| 159-fad2-1b/159-fatBf/159-fad3c | PHP41784A | AFS 6784.1.1 | 10GR32-47 | 6 | 2.0 | 2.6 | 89.7 | 3.5 | 2.2 | Homoz Pos |
| 159-fad2-1b/159-fatBf/159-fad3c | PHP41784A | AFS 6784.1.1 | 10GR32-47 | 7 | 1.9 | 2.3 | 89.6 | 3.6 | 2.6 | Homoz Pos |
| 159-fad2-1b/159-fatBf/159-fad3c | PHP41784A | AFS 6784.1.1 | 10GR32-47 | 8 | 2.0 | 2.7 | 88.4 | 3.9 | 2.9 | Homoz Pos |
| 159-fad2-1b/159-fatBf/159-fad3c | PHP41784A | AFS 6784.1.1 | 10GR32-47 | 9 | 1.9 | 2.3 | 89.6 | 3.6 | 2.6 | Homoz Pos |
| 159-fad2-1b/159-fatBf/159-fad3c | PHP41784A | AFS 6784.1.1 | 10GR32-47 | 10 | 2.1 | 2.6 | 87.9 | 4.8 | 2.7 | Homoz Pos |
| 159-fad2-1b/159-fatBf/159-fad3c | PHP41784A | AFS 6784.1.1 | 10GR32-52 | 1 | 1.9 | 2.1 | 89.8 | 3.3 | 3.0 | Homoz Pos |

TABLE 13-continued

Fatty acid profile for T2 seed analyzed from soy transformed with
PHP41784, containing the 159-fad2-1b & 159-fatBF& 159-fad3c amiRNAs, grown in
the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.1.1 | 10GR32-52 | 2 | 2.2 | 2.6 | 85.9 | 2.5 | 6.8 | Homoz Pos |
| 159-fad2-1b/159-fatBf/159-fad3c | PHP41784A | AFS 6784.1.1 | 10GR32-52 | 3 | 2.0 | 2.3 | 88.4 | 4.1 | 3.2 | Homoz Pos |
| 159-fad2-1b/159-fatBf/159-fad3c | PHP41784A | AFS 6784.1.1 | 10GR32-52 | 4 | 1.9 | 2.9 | 87.1 | 4.9 | 3.1 | Homoz Pos |
| 159-fad2-1b/159-fatBf/159-fad3c | PHP41784A | AFS 6784.1.1 | 10GR32-52 | 5 | 1.9 | 2.3 | 88.3 | 4.7 | 2.8 | Homoz Pos |
| 159-fad2-1b/159-fatBf/159-fad3c | PHP41784A | AFS 6784.1.1 | 10GR32-52 | 6 | 2.1 | 2.4 | 88.3 | 4.4 | 2.9 | Homoz Pos |
| 159-fad2-1b/159-fatBf/159-fad3c | PHP41784A | AFS 6784.1.1 | 10GR32-52 | 7 | 2.0 | 2.2 | 88.5 | 3.7 | 3.6 | Homoz Pos |
| 159-fad2-1b/159-fatBf/159-fad3c | PHP41784A | AFS 6784.1.1 | 10GR32-52 | 8 | 1.9 | 1.9 | 88.2 | 4.8 | 3.1 | Homoz Pos |
| 159-fad2-1b/159-fatBf/159-fad3c | PHP41784A | AFS 6784.1.1 | 10GR32-52 | 9 | 1.8 | 2.4 | 89.4 | 3.8 | 2.5 | Homoz Pos |
| 159-fad2-1b/159-fatBf/159-fad3c | PHP41784A | AFS 6784.1.1 | 10GR32-52 | 10 | 2.0 | 2.7 | 86.7 | 4.7 | 4.0 | Homoz Pos |
| 159-fad2-1b/159-fatBf/159-fad3c | PHP41784A | AFS 6784.2.1 | 10GR32-62 | 1 | 10.8 | 3.3 | 18.3 | 56.5 | 11.0 | Null |
| 159-fad2-1b/159-fatBf/159-fad3c | PHP41784A | AFS 6784.2.1 | 10GR32-62 | 2 | 11.3 | 3.5 | 15.3 | 58.0 | 11.9 | Null |
| 159-fad2-1b/159-fatBf/159-fad3c | PHP41784A | AFS 6784.2.1 | 10GR32-71 | 1 | 12.2 | 3.1 | 20.5 | 55.0 | 9.1 | Null |
| 159-fad2-1b/159-fatBf/159-fad3c | PHP41784A | AFS 6784.2.1 | 10GR32-71 | 2 | 13.1 | 3.2 | 14.6 | 57.6 | 11.5 | Null |
| 159-fad2-1b/159-fatBf/159-fad3c | PHP41784A | AFS 6784.2.1 | 10GR32-64 | 1 | 2.9 | 2.1 | 87.9 | 5.3 | 1.8 | Homoz Pos |

TABLE 13-continued

Fatty acid profile for T2 seed analyzed from soy transformed with PHP41784, containing the 159-fad2-1b & 159-fatBF& 159-fad3c amiRNAs, grown in the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.2.1 | 10GR32-64 | 2 | 2.7 | 2.1 | 88.3 | 5.2 | 1.7 | Homoz Pos |
| 159-fad2-1b/159-fatBf/159-fad3c | PHP41784A | AFS 6784.2.1 | 10GR32-64 | 3 | 2.8 | 2.1 | 89.3 | 4.4 | 1.4 | Homoz Pos |
| 159-fad2-1b/159-fatBf/159-fad3c | PHP41784A | AFS 6784.2.1 | 10GR32-64 | 4 | 6.7 | 2.5 | 83.8 | 5.5 | 1.5 | Homoz Pos |
| 159-fad2-1b/159-fatBf/159-fad3c | PHP41784A | AFS 6784.2.1 | 10GR32-64 | 5 | 2.7 | 2.0 | 89.6 | 4.4 | 1.4 | Homoz Pos |
| 159-fad2-1b/159-fatBf/159-fad3c | PHP41784A | AFS 6784.2.1 | 10GR32-64 | 6 | 3.0 | 2.4 | 88.5 | 4.6 | 1.4 | Homoz Pos |
| 159-fad2-1b/159-fatBf/159-fad3c | PHP41784A | AFS 6784.2.1 | 10GR32-64 | 7 | 1.8 | 1.9 | 90.8 | 4.2 | 1.3 | Homoz Pos |
| 159-fad2-1b/159-fatBf/159-fad3c | PHP41784A | AFS 6784.2.1 | 10GR32-64 | 8 | 3.1 | 2.6 | 87.2 | 5.3 | 1.7 | Homoz Pos |
| 159-fad2-1b/159-fatBf/159-fad3c | PHP41784A | AFS 6784.2.1 | 10GR32-64 | 9 | 2.9 | 2.2 | 88.3 | 4.9 | 1.7 | Homoz Pos |
| 159-fad2-1b/159-fatBf/159-fad3c | PHP41784A | AFS 6784.2.1 | 10GR32-64 | 10 | 2.8 | 2.2 | 89.3 | 4.4 | 1.4 | Homoz Pos |
| 159-fad2-1b/159-fatBf/159-fad3c | PHP41784A | AFS 6784.2.1 | 10GR32-66 | 1 | 6.5 | 2.5 | 83.1 | 6.3 | 1.6 | Homoz Pos |
| 159-fad2-1b/159-fatBf/159-fad3c | PHP41784A | AFS 6784.2.1 | 10GR32-66 | 2 | 2.0 | 2.2 | 90.3 | 4.2 | 1.3 | Homoz Pos |
| 159-fad2-1b/159-fatBf/159-fad3c | PHP41784A | AFS 6784.2.1 | 10GR32-66 | 3 | 4.9 | 2.5 | 86.6 | 4.5 | 1.4 | Homoz Pos |
| 159-fad2-1b/159-fatBf/159-fad3c | PHP41784A | AFS 6784.2.1 | 10GR32-66 | 4 | 2.6 | 2.3 | 89.7 | 4.2 | 1.3 | Homoz Pos |
| 159-fad2-1b/159-fatBf/159-fad3c | PHP41784A | AFS 6784.2.1 | 10GR32-66 | 5 | 2.9 | 2.2 | 89.1 | 4.7 | 1.1 | Homoz Pos |

TABLE 13-continued

Fatty acid profile for T2 seed analyzed from soy transformed with
PHP41784, containing the 159-fad2-1b & 159-fatBF & 159-fad3c amiRNAs, grown in
the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.2.1 | 10GR32-66 | 6 | 2.6 | 1.9 | 89.6 | 4.4 | 1.5 | Homoz Pos |
| 159-fad2-1b/159-fatBf/159-fad3c | PHP41784A | AFS 6784.2.1 | 10GR32-66 | 7 | 2.6 | 2.0 | 89.5 | 4.6 | 1.3 | Homoz Pos |
| 159-fad2-1b/159-fatBf/159-fad3c | PHP41784A | AFS 6784.2.1 | 10GR32-66 | 8 | 1.9 | 2.4 | 90.0 | 4.3 | 1.4 | Homoz Pos |
| 159-fad2-1b/159-fatBf/159-fad3c | PHP41784A | AFS 6784.2.1 | 10GR32-66 | 9 | 2.8 | 2.1 | 90.2 | 3.7 | 1.2 | Homoz Pos |
| 159-fad2-1b/159-fatBf/159-fad3c | PHP41784A | AFS 6784.2.1 | 10GR32-66 | 10 | 6.0 | 2.3 | 85.2 | 5.1 | 1.4 | Homoz Pos |
| 159-fad2-1b/159-fatBf/159-fad3c | PHP41784A | AFS 6784.2.1 | 10GR32-67 | 1 | 1.9 | 2.6 | 90.2 | 4.0 | 1.3 | Homoz Pos |
| 159-fad2-1b/159-fatBf/159-fad3c | PHP41784A | AFS 6784.2.1 | 10GR32-67 | 2 | 1.8 | 2.2 | 90.8 | 3.8 | 1.4 | Homoz Pos |
| 159-fad2-1b/159-fatBf/159-fad3c | PHP41784A | AFS 6784.2.1 | 10GR32-67 | 3 | 1.9 | 2.0 | 90.4 | 4.2 | 1.5 | Homoz Pos |
| 159-fad2-1b/159-fatBf/159-fad3c | PHP41784A | AFS 6784.2.1 | 10GR32-67 | 4 | 1.8 | 2.0 | 90.2 | 4.6 | 1.5 | Homoz Pos |
| 159-fad2-1b/159-fatBf/159-fad3c | PHP41784A | AFS 6784.2.1 | 10GR32-67 | 5 | 1.8 | 2.1 | 90.5 | 4.2 | 1.5 | Homoz Pos |
| 159-fad2-1b/159-fatBf/159-fad3c | PHP41784A | AFS 6784.2.1 | 10GR32-67 | 6 | 1.9 | 2.8 | 89.9 | 3.9 | 1.5 | Homoz Pos |
| 159-fad2-1b/159-fatBf/159-fad3c | PHP41784A | AFS 6784.2.1 | 10GR32-67 | 7 | 1.8 | 1.9 | 89.4 | 5.0 | 2.0 | Homoz Pos |
| 159-fad2-1b/159-fatBf/159-fad3c | PHP41784A | AFS 6784.2.1 | 10GR32-67 | 8 | 1.9 | 2.3 | 90.6 | 3.8 | 1.5 | Homoz Pos |
| 159-fad2-1b/159-fatBf/159-fad3c | PHP41784A | AFS 6784.2.1 | 10GR32-67 | 9 | 1.8 | 1.8 | 90.7 | 4.3 | 1.5 | Homoz Pos |

TABLE 13-continued

Fatty acid profile for T2 seed analyzed from soy transformed with
PHP41784, containing the 159-fad2-1b & 159-fatBF& 159-fad3c amiRNAs, grown in
the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.2.1 | 10GR32-67 | 10 | 1.8 | 2.1 | 90.1 | 4.5 | 1.5 | Homoz Pos |
| 159-fad2-1b/159-fatBf/159-fad3c | PHP41784A | AFS 6784.2.1 | 10GR32-77 | 1 | 3.6 | 2.7 | 86.6 | 5.6 | 1.5 | Homoz Pos |
| 159-fad2-1b/159-fatBf/159-fad3c | PHP41784A | AFS 6784.2.1 | 10GR32-77 | 2 | 2.0 | 2.1 | 87.3 | 6.8 | 1.8 | Homoz Pos |
| 159-fad2-1b/159-fatBf/159-fad3c | PHP41784A | AFS 6784.2.1 | 10GR32-77 | 3 | 2.7 | 2.4 | 88.9 | 4.7 | 1.4 | Homoz Pos |
| 159-fad2-1b/159-fatBf/159-fad3c | PHP41784A | AFS 6784.2.1 | 10GR32-77 | 4 | 3.3 | 2.6 | 89.1 | 3.7 | 1.3 | Homoz Pos |
| 159-fad2-1b/159-fatBf/159-fad3c | PHP41784A | AFS 6784.2.1 | 10GR32-77 | 5 | 3.6 | 2.6 | 87.9 | 4.3 | 1.6 | Homoz Pos |
| 159-fad2-1b/159-fatBf/159-fad3c | PHP41784A | AFS 6784.2.1 | 10GR32-77 | 6 | 2.3 | 2.8 | 89.9 | 3.8 | 1.2 | Homoz Pos |
| 159-fad2-1b/159-fatBf/159-fad3c | PHP41784A | AFS 6784.2.1 | 10GR32-77 | 7 | 5.8 | 2.7 | 86.6 | 3.8 | 1.2 | Homoz Pos |
| 159-fad2-1b/159-fatBf/159-fad3c | PHP41784A | AFS 6784.2.1 | 10GR32-77 | 8 | 2.9 | 2.1 | 89.9 | 3.7 | 1.4 | Homoz Pos |
| 159-fad2-1b/159-fatBf/159-fad3c | PHP41784A | AFS 6784.2.1 | 10GR32-77 | 9 | 3.4 | 2.7 | 87.6 | 4.9 | 1.4 | Homoz Pos |
| 159-fad2-1b/159-fatBf/159-fad3c | PHP41784A | AFS 6784.2.1 | 10GR32-77 | 10 | 7.1 | 2.1 | 84.7 | 4.6 | 1.5 | Homoz Pos |
| 159-fad2-1b/159-fatBf/159-fad3c | PHP41784A | AFS 6784.3.2 | 10GR32-82 | 1 | 11.5 | 3.6 | 19.1 | 55.1 | 10.7 | Null |
| 159-fad2-1b/159-fatBf/159-fad3c | PHP41784A | AFS 6784.3.2 | 10GR32-82 | 2 | 11.6 | 3.6 | 18.6 | 55.9 | 10.3 | Null |
| 159-fad2-1b/159-fatBf/159-fad3c | PHP41784A | AFS 6784.3.2 | 10GR32-84 | 1 | 11.6 | 3.5 | 21.2 | 54.3 | 9.5 | Null |

TABLE 13-continued

Fatty acid profile for T2 seed analyzed from soy transformed with
PHP41784, containing the 159-fad2-1b & 159-fatBF& 159-fad3c amiRNAs, grown in
the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.3.2 | 10GR32-84 | 2 | 11.7 | 3.8 | 18.4 | 56.5 | 9.6 | Null |
| 159-fad2-1b/159-fatBf/159-fad3c | PHP41784A | AFS 6784.3.2 | 10GR32-91 | 1 | 1.9 | 2.0 | 90.2 | 4.0 | 2.0 | Homoz Pos |
| 159-fad2-1b/159-fatBf/159-fad3c | PHP41784A | AFS 6784.3.2 | 10GR32-91 | 2 | 2.0 | 2.2 | 90.0 | 3.5 | 2.3 | Homoz Pos |
| 159-fad2-1b/159-fatBf/159-fad3c | PHP41784A | AFS 6784.3.2 | 10GR32-91 | 3 | 1.8 | 2.5 | 89.5 | 3.4 | 2.8 | Homoz Pos |
| 159-fad2-1b/159-fatBf/159-fad3c | PHP41784A | AFS 6784.3.2 | 10GR32-91 | 4 | 1.9 | 2.5 | 89.4 | 3.6 | 2.5 | Homoz Pos |
| 159-fad2-1b/159-fatBf/159-fad3c | PHP41784A | AFS 6784.3.2 | 10GR32-91 | 5 | 1.8 | 2.3 | 90.0 | 3.4 | 2.5 | Homoz Pos |
| 159-fad2-1b/159-fatBf/159-fad3c | PHP41784A | AFS 6784.3.2 | 10GR32-91 | 6 | 1.9 | 2.3 | 90.1 | 3.3 | 2.4 | Homoz Pos |
| 159-fad2-1b/159-fatBf/159-fad3c | PHP41784A | AFS 6784.3.2 | 10GR32-91 | 7 | 1.9 | 2.4 | 90.2 | 3.3 | 2.3 | Homoz Pos |
| 159-fad2-1b/159-fatBf/159-fad3c | PHP41784A | AFS 6784.3.2 | 10GR32-91 | 8 | 2.0 | 2.5 | 89.9 | 3.4 | 2.2 | Homoz Pos |
| 159-fad2-1b/159-fatBf/159-fad3c | PHP41784A | AFS 6784.3.2 | 10GR32-91 | 9 | 1.9 | 2.3 | 88.3 | 4.4 | 3.0 | Homoz Pos |
| 159-fad2-1b/159-fatBf/159-fad3c | PHP41784A | AFS 6784.3.2 | 10GR32-91 | 10 | 1.8 | 2.1 | 90.6 | 3.6 | 1.9 | Homoz Pos |
| 159-fad2-1b/159-fatBf/159-fad3c | PHP41784A | AFS 6784.3.2 | 10GR32-93 | 1 | 2.1 | 2.8 | 87.8 | 4.5 | 2.8 | Homoz Pos |
| 159-fad2-1b/159-fatBf/159-fad3c | PHP41784A | AFS 6784.3.2 | 10GR32-93 | 2 | 2.2 | 2.9 | 87.6 | 4.5 | 2.8 | Homoz Pos |
| 159-fad2-1b/159-fatBf/159-fad3c | PHP41784A | AFS 6784.3.2 | 10GR32-93 | 3 | 2.2 | 2.7 | 87.3 | 4.6 | 3.2 | Homoz Pos |

TABLE 13-continued

Fatty acid profile for T2 seed analyzed from soy transformed with PHP41784, containing the 159-fad2-1b & 159-fatBF& 159-fad3c amiRNAs, grown in the greenhouse.

| Ami-RNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.3.2 | 10GR32-93 | 4 | 2.3 | 2.9 | 86.9 | 4.8 | 3.1 | Homoz Pos |
| 159-fad2-1b/159-fatBf/159-fad3c | PHP41784A | AFS 6784.3.2 | 10GR32-93 | 5 | 2.3 | 3.0 | 86.2 | 5.0 | 3.5 | Homoz Pos |
| 159-fad2-1b/159-fatBf/159-fad3c | PHP41784A | AFS 6784.3.2 | 10GR32-93 | 6 | 2.3 | 3.2 | 84.5 | 6.2 | 3.8 | Homoz Pos |
| 159-fad2-1b/159-fatBf/159-fad3c | PHP41784A | AFS 6784.3.2 | 10GR32-93 | 7 | 2.1 | 2.8 | 85.2 | 6.0 | 3.8 | Homoz Pos |
| 159-fad2-1b/159-fatBf/159-fad3c | PHP41784A | AFS 6784.3.2 | 10GR32-93 | 8 | 2.2 | 2.9 | 86.3 | 5.3 | 3.2 | Homoz Pos |
| 159-fad2-1b/159-fatBf/159-fad3c | PHP41784A | AFS 6784.3.2 | 10GR32-93 | 9 | 2.2 | 2.9 | 86.4 | 4.9 | 3.5 | Homoz Pos |
| 159-fad2-1b/159-fatBf/159-fad3c | PHP41784A | AFS 6784.3.2 | 10GR32-93 | 10 | 2.2 | 2.9 | 86.7 | 5.0 | 3.2 | Homoz Pos |
| 159-fad2-1b/159-fatBf/159-fad3c | PHP41784A | AFS 6784.3.2 | 10GR32-96 | 1 | 1.9 | 2.4 | 90.0 | 3.3 | 2.4 | Homoz Pos |
| 159-fad2-1b/159-fatBf/159-fad3c | PHP41784A | AFS 6784.3.2 | 10GR32-96 | 2 | 2.0 | 2.7 | 89.0 | 3.8 | 2.5 | Homoz Pos |
| 159-fad2-1b/159-fatBf/159-fad3c | PHP41784A | AFS 6784.3.2 | 10GR32-96 | 3 | 2.1 | 2.5 | 90.0 | 3.3 | 2.1 | Homoz Pos |
| 159-fad2-1b/159-fatBf/159-fad3c | PHP41784A | AFS 6784.3.2 | 10GR32-96 | 4 | 2.0 | 2.8 | 89.1 | 3.4 | 2.7 | Homoz Pos |
| 159-fad2-1b/159-fatBf/159-fad3c | PHP41784A | AFS 6784.3.2 | 10GR32-96 | 5 | 2.0 | 2.6 | 89.6 | 3.5 | 2.3 | Homoz Pos |
| 159-fad2-1b/159-fatBf/159-fad3c | PHP41784A | AFS 6784.3.2 | 10GR32-96 | 6 | 2.1 | 2.8 | 89.4 | 3.5 | 2.2 | Homoz Pos |
| 159-fad2-1b/159-fatBf/159-fad3c | PHP41784A | AFS 6784.3.2 | 10GR32-96 | 7 | 1.8 | 2.4 | 90.6 | 3.1 | 2.0 | Homoz Pos |

TABLE 13-continued

Fatty acid profile for T2 seed analyzed from soy transformed with
PHP41784, containing the 159-fad2-1b & 159-fatBF& 159-fad3c amiRNAs, grown in
the greenhouse.

| AmiRNA(s) | Construct | Event | T2 Seed Analyzed | Seed No. | 16:0 | 18:0 | 18:1 | 18:2 | 18:3 | T2 Seed Comment |
|---|---|---|---|---|---|---|---|---|---|---|
| 159-fad2-1b/159-fatBf/159-fad3c | PHP41784A | AFS 6784.3.2 | 10GR32-96 | 8 | 1.9 | 2.2 | 90.7 | 3.4 | 1.9 | Homoz Pos |
| 159-fad2-1b/159-fatBf/159-fad3c | PHP41784A | AFS 6784.3.2 | 10GR32-96 | 9 | 1.9 | 2.4 | 90.1 | 3.5 | 2.1 | Homoz Pos |
| 159-fad2-1b/159-fatBf/159-fad3c | PHP41784A | AFS 6784.3.2 | 10GR32-96 | 10 | 1.9 | 2.3 | 90.0 | 3.6 | 2.3 | Homoz Pos |
| 159-fad2-1b/159-fatBf/159-fad3c | PHP41784A | AFS 6784.3.2 | 10GR32-99 | 1 | 2.0 | 2.9 | 87.3 | 4.9 | 2.8 | Homoz Pos |
| 159-fad2-1b/159-fatBf/159-fad3c | PHP41784A | AFS 6784.3.2 | 10GR32-99 | 2 | 2.0 | 2.4 | 88.5 | 4.8 | 2.3 | Homoz Pos |
| 159-fad2-1b/159-fatBf/159-fad3c | PHP41784A | AFS 6784.3.2 | 10GR32-99 | 3 | 2.0 | 3.1 | 87.6 | 4.5 | 2.8 | Homoz Pos |
| 159-fad2-1b/159-fatBf/159-fad3c | PHP41784A | AFS 6784.3.2 | 10GR32-99 | 4 | 2.1 | 3.1 | 87.5 | 4.7 | 2.5 | Homoz Pos |
| 159-fad2-1b/159-fatBf/159-fad3c | PHP41784A | AFS 6784.3.2 | 10GR32-99 | 5 | 2.1 | 2.7 | 87.3 | 5.3 | 2.6 | Homoz Pos |
| | | 93B86 | 10GR32-102 | 1 | 11.8 | 3.8 | 18.4 | 56.1 | 10.0 | |
| | | 93B86 | 10GR32-102 | 2 | 10.9 | 3.5 | 19.9 | 55.6 | 10.0 | |
| | | 93B86 | 10GR32-104 | 1 | 12.1 | 4.5 | 17.4 | 54.9 | 11.1 | |
| | | 93B86 | 10GR32-104 | 2 | 11.8 | 3.9 | 19.2 | 55.0 | 10.2 | |

Table 13 shows that T2 seed from events expressing the 159-fad2-1b & 159-fatBF& 159-fad3c amiRNAs have palmitic acid contents ranging from 1.8% to 7.1%, oleic acid contents ranging from 83.1% to 90.8% and alpha-linolenic acid contents ranging from 1.1% to 6.8%. T2 seed from null segregant seed have palmitic acid contents ranging from 10.8% to 13.1%, oleic acid contents ranging from 14.6% to 21.2% and alpha-linolenic acid contents ranging from 9.1% to 11.9%. The elite variety which was transformed (93B86) has palmitic acid contents ranging from 10.9% to 12.1%, oleic acid contents ranging from 16.3% to 19.9% and alpha-linolenic acid contents ranging from 10.0% to 11.5%.

Analysis of Fatty Acid Profiles of Seed from Events Expressing amiRNAs Grown in the Field in Iowa Seed representative for each experiment from different events were planted in multiple reps in 4 different locations in Iowa (Johnston, Stuart, Griswold & Washington) along with suitable null segregants and Jack or 93B86 controls. Typically, reps were planted in rows having from 30 seed (short rows) up to around 220 seed for longer rows.

Seed were harvested and two 5-seed bulk aliquots from each row were crushed, lipids were derivitized with TMSH and FAMEs were analyzed by GC as described inter alia. The resulting two 5-seed bulk fatty acid profiles were then averaged to obtain the average fatty acid profile for seeds from that row.

The average 5-seed bulk fatty acid profiles from all rows for a given event within an experiment were then averaged to obtain an overall average fatty acid profile for seed from that event when grown in the field. This was also done for null segregants within an event and with the Jack and 93B86 controls.

The average fatty acid profiles for field grown seed analyzed from soy transformed with PHP32510, containing the 369b-fad2-1b amiRNA or PHP32511, containing the 159-fad2-1b amiRNA or PHP32843, containing the 369b- fad2-1b & 159-fad2-2 amiRNAs or PHP33705, containing the 396-fad2-1b & 396b-sad3 amiRNAs or PHP38557, containing the 159-fad3c amiRNA or PHP41103, containing the 159-fatBF amiRNA or PHP41784, containing the 159-fad2-1b & 159-fatBF& 159-fad3c amiRNAs are shown in Table 14.

TABLE 14

Average fatty acid profiles for seed grown in the field in four locations in Iowa.

| Ami-RNA(s) | Construct | Event | Avg. 16:0 | Avg. 18:0 | Avg. 18:1 | Avg. 18:2 | Avg. 18:3 | T2 Seed Comment |
|---|---|---|---|---|---|---|---|---|
| 396b-fad2-1b | PHP32510 A | AFS 5260.3.3 | 9.1 | 4.3 | 23.4 | 55.5 | 7.6 | Null |
| 396b-fad2-1b | PHP32510 A | AFS 5260.3.11 | 9.1 | 4.4 | 31.0 | 48.5 | 6.9 | Null |
| 396b-fad2-1b | PHP32510 A | AFS 5260.2.3 | 6.0 | 3.7 | 80.8 | 4.6 | 4.7 | Homoz Pos |
| 396b-fad2-1b | PHP32510 A | AFS 5260.3.6 | 6.2 | 3.6 | 80.6 | 5.0 | 4.5 | Homoz Pos |
| 396b-fad2-1b | PHP32510 A | AFS 5260.4.5 | 6.1 | 3.9 | 82.0 | 3.5 | 4.4 | Homoz Pos |
| 159-fad2-1b | PHP32511 A | AFS 5292.1.4 | 6.5 | 4.0 | 77.1 | 6.8 | 5.4 | Homoz Pos |
| 159-fad2-1b | PHP32511 A | AFS 5292.5.8 | 6.1 | 4.0 | 81.5 | 3.8 | 4.4 | Homoz Pos |
| 159-fad2-1b | PHP32511 A | AFS 5292.6.5 | 7.0 | 4.2 | 71.2 | 11.7 | 5.9 | Homoz Pos |
| 159-fad2-1b | PHP32511 A | AFS 5292.7.2 | 6.3 | 3.8 | 75.7 | 8.4 | 5.6 | Homoz Pos |
| 159-fad2-1b | PHP32511 A | AFS 5292.7.6 | 6.1 | 4.1 | 81.3 | 3.9 | 4.6 | Homoz Pos |
| 396b-fad2-1b/ 159-fad2-2 | PHP32843 A | EAFS 5396.2.2 | 5.6 | 3.5 | 88.8 | 0.5 | 1.5 | Homoz Pos |
| 396b-fad2-1b/ 159-fad2-2 | PHP32843 A | EAFS 5396.2.3 | 5.5 | 3.5 | 88.7 | 0.6 | 1.6 | Homoz Pos |
| 396b-fad2-1b/ 159-fad2-2 | PHP32843 A | EAFS 5396.3.8 | 5.7 | 3.4 | 87.8 | 1.0 | 2.0 | Homoz Pos |
| 396-fad2-1b/ 396 b-sad3 | PHP33705 A | AFS 5489.3.2 | 9.1 | 4.4 | 22.7 | 55.7 | 7.9 | Null |
| 396-fad2-1b/ 396 b-sad3 | PHP33705 A | AFS 5489.3.4 | 9.2 | 4.1 | 24.2 | 56.0 | 6.5 | Null |
| 396-fad2-1b/ 396 b-sad3 | PHP33705 A | AFS 5489.4.1 | 9.4 | 4.3 | 22.4 | 56.0 | 7.9 | Null |
| 396-fad2-1b/ 396 b-sad3 | PHP33705 A | AFS 5489.3.2 | 6.3 | 11.4 | 61.6 | 14.7 | 5.9 | Homoz Pos |
| 396-fad2-1b/ 396 b-sad3 | PHP33705 A | AFS 5489.3.4 | 6.2 | 13.1 | 63.2 | 11.8 | 5.6 | Homoz Pos |
| 396-fad2-1b/ 396 b-sad3 | PHP33705 A | AFS 5489.4.1 | 5.5 | 14.2 | 65.7 | 8.4 | 6.1 | Homoz Pos |
| 159-fad3c | PHP38557 A | AFS 6272.1.4 | 8.3 | 4.3 | 23.8 | 55.9 | 7.6 | Null |
| 159-fad3c | PHP38557 A | AFS 6272.2.1 | 9.3 | 4.4 | 24.3 | 54.5 | 7.4 | Null |
| 159-fad3c | PHP38557 A | AFS 6272.2.3 | 9.2 | 4.3 | 23.1 | 55.8 | 7.5 | Null |
| 159-fad3c | PHP38557 A | AFS 6272.1.4 | 9.2 | 4.1 | 25.4 | 56.3 | 4.8 | Homoz Pos |
| 159-fad3c | PHP38557 A | AFS 6272.2.1 | 9.2 | 4.2 | 26.9 | 57.6 | 2.1 | Homoz Pos |
| 159-fad3c | PHP38557 A | AFS 6272.2.3 | 9.4 | 4.1 | 24.6 | 57.4 | 4.4 | Homoz Pos |
| 159-fatBF | PHP41103 A | AFS 6671.1.4 | 9.5 | 3.8 | 20.6 | 57.0 | 9.1 | Null |
| 159-fatBF | PHP41103 A | AFS 6671.1.6 | 9.9 | 4.0 | 21.4 | 56.5 | 8.1 | Null |
| 159-fatBF | PHP41103 A | AFS 6671.3.2 | 10.4 | 3.9 | 19.9 | 57.3 | 8.6 | Null |
| 159-fatBF | PHP41103 A | AFS 6671.6.1 | 10.0 | 4.0 | 21.0 | 57.1 | 7.8 | Null |
| 159-fatBF | PHP41103 A | AFS 6671.6.3 | 10.6 | 4.1 | 21.0 | 56.3 | 8.0 | Null |
| 159-fatBF | PHP41103 A | AFS 6671.11.2 | 10.0 | 3.9 | 20.3 | 57.3 | 8.3 | Null |
| 159-fatBF | PHP41103 A | AFS 6671.11.3 | 10.2 | 3.8 | 20.2 | 57.1 | 8.7 | Null |
| 159-fatBF | PHP41103 A | AFS 6671.1.4 | 2.2 | 3.1 | 23.7 | 62.4 | 8.5 | Homoz Pos |
| 159-fatBF | PHP41103 A | AFS 6671.1.6 | 1.9 | 3.1 | 23.7 | 62.7 | 8.6 | Homoz Pos |
| 159-fatBF | PHP41103 A | AFS 6671.3.2 | 3.3 | 3.9 | 24.8 | 59.6 | 8.4 | Homoz Pos |
| 159-fatBF | PHP41103 A | AFS 6671.6.1 | 1.9 | 3.2 | 23.9 | 63.3 | 7.6 | Homoz Pos |
| 159-fatBF | PHP41103 A | AFS 6671.6.3 | 2.5 | 3.3 | 23.4 | 62.9 | 7.9 | Homoz Pos |
| 159-fatBF | PHP41103 A | AFS 6671.11.2 | 2.1 | 3.3 | 22.5 | 63.6 | 8.5 | Homoz Pos |
| 159-fatBF | PHP41103 A | AFS 6671.11.3 | 2.2 | 3.1 | 23.9 | 62.1 | 8.6 | Homoz Pos |
| 159-fad2-1b/ 159-fatBf/ 159-fad3c | PHP41784 A | AFS 6784.1.1 | 9.9 | 3.5 | 18.9 | 57.7 | 9.8 | Null |
| 159-fad2-1b/ 159-fatBf/ 159-fad3c | PHP41784 A | AFS 6784.2.1 | 12.0 | 3.5 | 18.1 | 57.3 | 9.0 | Null |
| 159-fad2-1b/ 159-fatBf/ 159-fad3c | PHP41784 A | AFS 6784.3.2 | 10.2 | 3.6 | 19.5 | 57.9 | 8.8 | Null |
| 159-fad2-1b/ 159-fatBf/ 159-fad3c | PHP41784 A | AFS 6784.1.1 | 2.0 | 2.7 | 82.9 | 9.5 | 2.7 | Homoz Pos |
| 159-fad2-1b/ 159-fatBf/ 159-fad3c | PHP41784 A | AFS 6784.2.1 | 2.8 | 2.6 | 83.1 | 9.8 | 1.5 | Homoz Pos |
| 159-fad2-1b/ 159-fatBf/ 159-fad3c | PHP41784 A | AFS 6784.3.2 | 1.9 | 2.7 | 83.6 | 9.5 | 2.2 | Homoz Pos |
| | | Jack Average | 9.5 | 4.1 | 21.6 | 56.9 | 7.9 | |
| | | 93B86 Average | 9.9 | 3.8 | 20.5 | 57.1 | 8.6 | |

Table 14 shows that fatty acid profiles in seed expressing various amiRNAs resemble that obtained for greenhouse grown seed and are stable when grown in the field.

Example 6

Generation of amiRNA Precursors to Silence *Arabidopsis* and *Brassica* Fatty Acid Biosynthetic Genes Key gene family sequences targeted for silencing in *Arabidopsis thaliana* and *Brassica napus* are the fatty acid desaturase 2 gene families, also known as delta-12 desaturase or omega-6 desaturase, the fatty acid desaturase 3 (fad3) gene family [Yadav, N. S., Wierzbicki, A., Aegerter, M., Caster, C. S., Perez-Grau, L., Kinney, A. J., Hitz, W. D., Booth, J. R. Jr., Schweiger, B., Stecca, K. L., Allen, S. M., Blackwell, M., Reiter, R. S., Carlson, T. J., Russell, S. H., Feldmann, K. A., Pierce, J. and Browse, J. Cloning of higher plant omega-3 fatty acid desaturases Plant Physiol. 103 (2), 467-476 (1993)] and the fatty acid elongase (fael) gene family (publication number US 2007/0204370 A1, filed Nov. 24, 2004)). A list of fatty acid biosynthetic genes targeted for silencing by amiRNAs, along with corresponding *Arabidopsis* or *Brassica* genome sequence gene identifier, nt SEQ ID NO and aa SEQ ID NO are shown in Table 15.

In Table 15, the gene identifier used for the corresponding *Brassica napus* genes is the NCBI Accession number for the coding sequence of the respective gene.

TABLE 15

*Arabidopsis thaliana* and *Brassica napus* Fatty Acid Biosynthetic Gene Sequences Targeted for Silencing

| Organism Targeted | Gene Family | Gene | nt SEQ ID NO | aa SEQ ID NO |
|---|---|---|---|---|
| *Arabidopsis* | Fad2 | At3g12120 | 44 | 45 |
| | Fad3 | At2g29980 | 46 | 47 |
| | FaeI | At4g34520 | 48 | 49 |
| *Brassica* | Fad2 | FJ907397 | 50 | 51 |
| | | FJ907398 | 52 | 53 |
| | | FJ907399 | 54 | 55 |
| | | FJ907400 | 56 | 57 |
| | | FJ907401 | 58 | 59 |
| | | AF124360 | 174 | 175 |
| | Fad3 | L01418 | 60 | 61 |
| | | AY599884 | 62 | 63 |
| | | L22962 | 64 | 65 |
| | FaeI | AF274750 | 66 | 67 |
| | | AY888043 | 68 | 69 |
| | | AF009563 | 70 | 71 |
| | | GU325719 | 72 | 73 |
| | | AF490462 | 74 | 75 |
| | | AF490459 | 76 | 77 |
| | | BNU50771 | 78 | 79 |

Design of Artificial microRNAs and Corresponding STAR Sequences amiRNAs and corresponding STAR sequences that pair with the amiRNAs were designed against the *Arabidopsis* and *Brassica* sequences as described in Example 1 and are listed in Table 16 along with their SEQ ID NOs.

TABLE 16 amiRNAs and corresponding STAR sequences targeting *Arabidopsis* and *Brassica* fatty acid biosynthetic sequences.

| amiRNA | amiRNA SEQ ID NO: | 159 Precursor STAR sequence SEQ ID NO: | 396 Precursor STAR sequence SEQ ID NO: |
|---|---|---|---|
| fad2a | 80 | 81 | 82 |
| fad2b | 83 | 84 | 85 |
| fad2c | 86 | 87 | 88 |
| fad3a | 89 | 90 | 91 |
| fad3b | 92 | 93 | 94 |
| faeIa | 95 | 96 | 97 |
| faeIb | 98 | 99 | 100 |
| faeIc | 101 | 102 | 103 |

Generation of In-Fusion™ Ready Expression Vectors

The microRNA GM-159 and GM-396b precursors (described in Example 1) were altered to include Pme I sites immediately flanking the star and microRNA sequences to form the In-Fusion™ ready microRNA precursors. These sequences were cloned into the Not I site of KS332 to form the In-Fusion™ ready microRNA GM-159-KS332 and GM-396b-KS332 plasmids (SEQ ID NO: 104 and SEQ ID NO: 105, respectively).

In order to remove the DSred cassette, GM-396b-KS332 (SEQ ID NO: 105) was digested with BamHI and the fragment containing the GM-396b precursor was re-ligated to produce pKR2007 (SEQ ID NO: 106).

Plasmid GM-159-KS332 (SEQ ID NO: 104) was digested with HindIII and the fragment containing the GM-159 precursor was cloned into the HindIII fragment of pKR2007 (SEQ ID NO: 106), containing vector backbone DNA, to produce pKR2009 (SEQ ID NO: 107).

In all of these expression vectors, the expression cassette (beta-conglycinin promoter:In-Fusion™ ready microRNA precursor:phaseolin terminator) is flanked by AscI sites.

Generation of amiRNA Precursors to Silence *Arabidopsis* and *Brassica* Fatty Acid Biosynthetic Genes When synthesizing amiRNA precursors in the GM-159 backbone, the microRNA GM-159 precursor (Example 1) was used as a PCR template. Oligonucleotide pairs were designed for each amiRNA/STAR sequence to be amplified using 5' and 3' oligonucleotide primers which are identical to the GM-159 precursor region at the 3' end of the oligonucleotide and which contain either the 21 bp amiRNA or STAR sequence of interest (as listed in Table 16) and a region homologous to either side of the PmeI site of pKR2009 (SEQ ID NO: 107) at the 5' end of the oligonucleotide. The oligonucleotide primers were designed according to the protocol provided by Clontech and do not leave any footprint of the Pme I sites after the In-Fusion™ recombination reaction.

A similar approach was used to design oligonucleotides for amiRNA precursors in the GM-396b backbone except microRNA GM-396b is used as PCR template and the 5' region of the oligonucleotide is homologous to either side of the PmeI site of pKR2007 (SEQ ID NO: 106).

The amplified DNA corresponding to each primer set was recombined into either pKR2007 or pKR2009, previously digested with PmeI to linearize the vector, using the manufacturer's protocols provided with the In-Fusion™ kit. In this way, expression vectors for each of the amiRNA/STAR sequences listed in Table 16 were produced.

These plasmids were then digested with AscI and the fragment containing the amiRNA expression cassette was sub-cloned into the AscI site of pKR92, which was previously described in WO2007/06110109 (published on May 31, 2007, the contents of which are herein incorporated by reference). The SEQ ID NOs of sequences for the resulting precursor amiRNAs, as well as the resulting plasmids containing amiRNA-396b or amiRNA-159 precursors suitable for silencing fad2, fad3 and faeI genes are listed in Table 17.

TABLE 17

Precursor amiRNAs and amiRNA Expression Constructs For *Arabidopsis* and *Brassica* Fatty Acid Biosynthetic Gene Sequences Targeted for Silencing

| Gene Family | amiRNA Precursor | amiRNA Precursor SEQ ID NO | Plasmid Name | Plasmid SEQ ID NO |
|---|---|---|---|---|
| fad2 | 159-Atfad2a | 136 | pKR2032 | 108 |
|  | 159-Atfad2b | 137 | pKR2033 | 109 |
|  | 159-Atfad2c | 138 | pKR2034 | 110 |
|  | 396b-Atfad2a | 139 | pKR2037 | 111 |
|  | 396b-Atfad2b | 140 | pKR2038 | 112 |
|  | 396b-Atfad2c | 141 | pKR2039 | 113 |
| fad3 | 159-Atfad3a | 142 | pKR2035 | 114 |
|  | 159-Atfad3b | 143 | pKR2036 | 115 |
|  | 396b-Atfad3a | 144 | pKR2040 | 116 |
|  | 396b-Atfad3b | 145 | pKR2041 | 117 |
| faeI | 159-AtfaeIa | 146 | pKR2076 | 118 |
|  | 159-AtfaeIb | 147 | pKR2077 | 119 |
|  | 159-AtfaeIc | 148 | pKR2078 | 120 |
|  | 396b-AtfaeIa | 149 | pKR2079 | 121 |
|  | 396b-AtfaeIb | 150 | pKR2081 | 122 |
|  | 396b-AtfaeIc | 151 | pKR2080 | 123 |

From Table 17, the amiRNA precursor 159-Atfad2a (SEQ ID NO: 136) is 958 nt in length and is substantially similar to the deoxyribonucleotide sequence set forth in SEQ ID NO: 152 wherein nucleotides 276 to 296 of SEQ ID NO: 152 are replaced by ATFAD2A amiRNA (SEQ ID NO: 80) and wherein nucleotides 121 to 141 of SEQ ID NO: 152 are replaced by 159-ATFAD2A Star Sequence (SEQ ID NO: 81). The genomic miRNA precursor sequences 159 and 396b were described previously in US20090155910A1 (WO 2009/079532) and their sequences are set forth in SEQ ID NO: 152 and SEQ ID NO: 153, respectively.

From Table 17, the amiRNA precursor 159-Atfad2b (SEQ ID NO: 137) is 958 nt in length and is substantially similar to the deoxyribonucleotide sequence set forth in SEQ ID NO: 152 wherein nucleotides 276 to 296 of SEQ ID NO: 152 are replaced by ATFAD2B amiRNA (SEQ ID NO: 83) and wherein nucleotides 121 to 141 of SEQ ID NO: 152 are replaced by 159-ATFAD2B Star Sequence (SEQ ID NO: 84).

From Table 17, the amiRNA precursor 159-Atfad2c (SEQ ID NO: 138) is 958 nt in length and is substantially similar to the deoxyribonucleotide sequence set forth in SEQ ID NO: 152 wherein nucleotides 276 to 296 of SEQ ID NO: 152 are replaced by ATFAD2c amiRNA (SEQ ID NO: 86) and wherein nucleotides 121 to 141 of SEQ ID NO: 152 are replaced by 159-ATFAD2c Star Sequence (SEQ ID NO: 87).

From Table 17, the amiRNA precursor 396b-Atfad2a (SEQ ID NO: 139) is 574 nt in length and is substantially similar to the deoxyribonucleotide sequence set forth in SEQ ID NO: 153 wherein nucleotides 196 to 216 of SEQ ID NO: 153 are replaced by ATFAD2A amiRNA (SEQ ID NO: 80) and wherein nucleotides 262 to 282 of SEQ ID NO: 153 are replaced by 396b-ATFAD2A Star Sequence (SEQ ID NO: 82).

From Table 17, the amiRNA precursor 396b-Atfad2b (SEQ ID NO: 140) is 574 nt in length and is substantially similar to the deoxyribonucleotide sequence set forth in SEQ ID NO: 153 wherein nucleotides 196 to 216 of SEQ ID NO: 153 are replaced by ATFAD2B amiRNA (SEQ ID NO: 83) and wherein nucleotides 262 to 282 of SEQ ID NO: 153 are replaced by 396b-ATFAD2B Star Sequence (SEQ ID NO: 85).

From Table 17, the amiRNA precursor 396b-Atfad2c (SEQ ID NO: 141) is 574 nt in length and is substantially similar to the deoxyribonucleotide sequence set forth in SEQ ID NO: 153 wherein nucleotides 196 to 216 of SEQ ID NO: 153 are replaced by ATFAD2c amiRNA (SEQ ID NO: 86) and wherein nucleotides 262 to 282 of SEQ ID NO: 153 are replaced by 396b-ATFAD2c Star Sequence (SEQ ID NO: 88).

From Table 17, the amiRNA precursor 159-Atfad3a (SEQ ID NO: 142) is 958 nt in length and is substantially similar to the deoxyribonucleotide sequence set forth in SEQ ID NO: 152 wherein nucleotides 276 to 296 of SEQ ID NO: 152 are replaced by ATFAD3A amiRNA (SEQ ID NO: 89) and wherein nucleotides 121 to 141 of SEQ ID NO: 152 are replaced by 159-ATFAD2A Star Sequence (SEQ ID NO: 90).

From Table 17, the amiRNA precursor 159-Atfad3b (SEQ ID NO: 143) is 958 nt in length and is substantially similar to the deoxyribonucleotide sequence set forth in SEQ ID NO: 152 wherein nucleotides 276 to 296 of SEQ ID NO: 152 are replaced by ATFAD3B amiRNA (SEQ ID NO: 92) and wherein nucleotides 121 to 141 of SEQ ID NO: 152 are replaced by 159-ATFAD3B Star Sequence (SEQ ID NO: 93).

From Table 17, the amiRNA precursor 396b-Atfad3a (SEQ ID NO: 144) is 574 nt in length and is substantially similar to the deoxyribonucleotide sequence set forth in SEQ ID NO: 153 wherein nucleotides 196 to 216 of SEQ ID NO: 153 are replaced by ATFAD3A amiRNA (SEQ ID NO: 89) and wherein nucleotides 262 to 282 of SEQ ID NO: 153 are replaced by 396b-ATFAD3A Star Sequence (SEQ ID NO: 91).

From Table 17, the amiRNA precursor 396b-Atfad2b (SEQ ID NO: 145) is 574 nt in length and is substantially similar to the deoxyribonucleotide sequence set forth in SEQ ID NO: 153 wherein nucleotides 196 to 216 of SEQ ID NO: 153 are replaced by ATFAD3B amiRNA (SEQ ID NO: 92) and wherein nucleotides 262 to 282 of SEQ ID NO: 153 are replaced by 396b-ATFAD3B Star Sequence (SEQ ID NO: 94).

From Table 17, the amiRNA precursor 159-AtfaeIa (SEQ ID NO: 146) is 958 nt in length and is substantially similar to the deoxyribonucleotide sequence set forth in SEQ ID NO: 152 wherein nucleotides 276 to 296 of SEQ ID NO: 152 are replaced by ATFAEIA amiRNA (SEQ ID NO: 95) and wherein nucleotides 121 to 141 of SEQ ID NO: 152 are replaced by 159-ATFAEIA Star Sequence (SEQ ID NO: 96).

From Table 17, the amiRNA precursor 159-AtfaeIb (SEQ ID NO: 147) is 958 nt in length and is substantially similar to the deoxyribonucleotide sequence set forth in SEQ ID NO: 152 wherein nucleotides 276 to 296 of SEQ ID NO: 152 are replaced by ATFAEIB amiRNA (SEQ ID NO: 98) and wherein nucleotides 121 to 141 of SEQ ID NO: 152 are replaced by 159-ATFAEIB Star Sequence (SEQ ID NO: 99).

From Table 17, the amiRNA precursor 159-Atfaalc (SEQ ID NO: 148) is 958 nt in length and is substantially similar to the deoxyribonucleotide sequence set forth in SEQ ID NO: 152 wherein nucleotides 276 to 296 of SEQ ID NO: 152 are replaced by ATFAEIc amiRNA (SEQ ID NO: 101) and wherein nucleotides 121 to 141 of SEQ ID NO: 152 are replaced by 159-ATFAEIc Star Sequence (SEQ ID NO: 102).

From Table 17, the amiRNA precursor 396b-AtfaeIa (SEQ ID NO: 149) is 574 nt in length and is substantially similar to the deoxyribonucleotide sequence set forth in SEQ ID NO: 153 wherein nucleotides 196 to 216 of SEQ ID NO: 153 are replaced by ATFAEIA amiRNA (SEQ ID NO: 95) and wherein nucleotides 262 to 282 of SEQ ID NO: 153 are replaced by 396b-ATFAEIA Star Sequence (SEQ ID NO: 97).

From Table 17, the amiRNA precursor 396b-AtfaeIb (SEQ ID NO: 150) is 574 nt in length and is substantially similar to the deoxyribonucleotide sequence set forth in SEQ ID NO: 153 wherein nucleotides 196 to 216 of SEQ ID NO: 153 are replaced by ATFAEIB amiRNA (SEQ ID NO: 98) and wherein nucleotides 262 to 282 of SEQ ID NO: 153 are replaced by 396b-ATFAEIB Star Sequence (SEQ ID NO: 100).

From Table 17, the amiRNA precursor 396b-AtfaeIc (SEQ ID NO: 151) is 574 nt in length and is substantially similar to the deoxyribonucleotide sequence set forth in SEQ ID NO: 153 wherein nucleotides 196 to 216 of SEQ ID NO: 153 are replaced by ATFAEIc amiRNA (SEQ ID NO: 101) and wherein nucleotides 262 to 282 of SEQ ID NO: 153 are replaced by 396b-ATFAEIc Star Sequence (SEQ ID NO: 103).

Example 7

Phenotypic Analysis of *Arabidopsis* Seed Expressing amiRNAs for Silencing Fatty Acid Biosynthetic Genes Transformation of *Arabidopsis* Plants Plasmids listed in Table 17 (Example 6) were introduced into *Agrobacterium tumefaciens* NTL4 (Luo et al, *Molecular Plant-Microbe Interactions* (2001) 14(1):98-103) by electroporation. Briefly, 1 µg plasmid DNA was mixed with 100 µL of electro-competent cells on ice. The cell suspension was transferred to a 100 µL electroporation cuvette (1 mm gap width) and electroporated using a BIORAD electroporator set to 1 kV, 40052 and 25 µF. Cells were transferred to 1 mL LB medium and incubated for 2 h at 30° C. Cells were plated onto LB medium containing 50 µg/mL kanamycin. Plates were incubated at 30° C. for 60 h. Recombinant *Agrobacterium* cultures (500 mL LB, 50 µg/mL kanamycin) were inoculated from single colonies of transformed *agrobacterium* cells and grown at 30° C. for 60 h. Cells were harvested by centrifugation (5000×g, 10 min) and resuspended in 1 L of 5% (W/N) sucrose containing 0.05% (V/V) Silwet. *Arabidopsis* plants were grown in soil at a density of 30 plants per 100 cm$^2$ pot in METRO-MIX® 360 soil mixture for 4 weeks (22° C., 16 h light/8 h dark, 100 µE m$-2_S-1$).

Plants were repeatedly dipped into the *Agrobacterium* suspension harboring the expression vectors listed in Table 17 and kept in a dark, high humidity environment for 24 h. Post dipping, plants were grown for three to four weeks under standard plant growth conditions described above and plant material was harvested and dried for one week at ambient temperatures in paper bags. Seeds were harvested using a 0.425 mm mesh brass sieve.

Cleaned *Arabidopsis* seeds (2 grams, corresponding to about 100,000 seeds) were sterilized by washes in 45 mL of 80% ethanol, 0.01% TRITON® X-100, followed by 45 mL of 30% (V/V) household bleach in water, 0.01% TRITON® X-100 and finally by repeated rinsing in sterile water. Aliquots of 20,000 seeds were transferred to square plates (20×20 cm) containing 150 mL of sterile plant growth medium comprised of 0.5×MS salts, 0.53% (WN) sorbitol, 0.05 MES/KOH (pH 5.8), 200 µg/mL TIMENTIN®, and 50 µg/mL kanamycin solidified with 10 g/L agar. Homogeneous dispersion of the seed on the medium was facilitated by mixing the aqueous seed suspension with an equal volume of melted plant growth medium. Plates were incubated under standard growth conditions for ten days. Kanamycin-resistant seedlings were transferred to plant growth medium without selective agent and grown for one week before transfer to soil. T1 Plants were grown to maturity alongside wt contral plants and T2 seeds were harvested.

Fatty Acid Analysis of Bulk T2 Seed

Approximately 10-25 *Arabidopsis* seed were crushed in 50 uL of TMSH using a plastic inoculating loop and 500 uL of hexane was added. After vortexing thoroughly, the hexane phase containing FAMEs were analyzed by GC as described in earlier examples and results for fatty acid profiles for approximately 10-20 events for each experiment are presented in Tables 18 to 33 below. In each Table, fatty acids are identified as 16:0 (palmitate), 18:0 (stearic acid), 18:1 (oleic acid), 18:2 (linoleic acid) and 18:3 (alpha-linolenic acid), 20:0 (eicosanoic acid), 20:1 eicosenoic acid) 20:2 (eicocadienoic acid) and 20:3 (eicosatrienoic acid) and results are expressed as a weight percent (wt. %) of total fatty acids. For constructs expressing a fad2 amiRNA, fatty acid profiles are sorted from highest 18:1 to lowest. For constructs expressing a fad3 amiRNA, fatty acids are sorted from lowest 18:3 to highest. For constructs expressing a faeI amiRNA, fatty acids are sorted from lowest to highest 20:1. A wild-type Columbia seed batch was also run and shown for comparison in each Table as col-0.

TABLE 18

Fatty acid profiles of lipid from bulk T2 seed samples for events transformed with pKR2032 expressing the 159-fad2a amiRNA

| Event | 16:0 | 18:0 | 18:1 | 18:2 | 18:3 | 20:0 | 20:1 | 20:2 |
|---|---|---|---|---|---|---|---|---|
| pKR2032-15 | 5.5 | 2.3 | 52.3 | 7.8 | 8.1 | 1.3 | 22.5 | 0.3 |
| pKR2032-4 | 6.5 | 2.7 | 49.3 | 8.2 | 7.9 | 1.4 | 23.7 | 0.3 |
| pKR2032-12 | 6.7 | 2.7 | 49.0 | 8.8 | 8.2 | 1.4 | 23.0 | 0.3 |
| pKR2032-8 | 6.6 | 2.8 | 48.9 | 9.2 | 8.4 | 1.3 | 22.6 | 0.4 |
| pKR2032-10 | 5.9 | 2.7 | 45.7 | 10.5 | 9.5 | 1.5 | 23.7 | 0.6 |
| pKR2032-7 | 6.6 | 2.9 | 45.6 | 10.9 | 10.0 | 1.5 | 21.9 | 0.5 |
| pKR2032-9 | 6.4 | 2.6 | 43.9 | 12.7 | 10.6 | 1.4 | 21.9 | 0.7 |
| pKR2032-2 | 6.5 | 2.9 | 43.4 | 11.8 | 11.3 | 1.3 | 22.3 | 0.6 |
| pKR2032-3 | 6.9 | 3.0 | 42.8 | 12.5 | 10.6 | 1.5 | 21.9 | 0.7 |
| pKR2032-5 | 6.7 | 2.8 | 42.0 | 11.8 | 11.4 | 1.6 | 23.1 | 0.6 |
| pKR2032-13 | 7.1 | 2.9 | 39.8 | 13.2 | 12.7 | 1.6 | 22.1 | 0.7 |
| pKR2032-14 | 7.2 | 2.7 | 39.5 | 13.5 | 12.6 | 1.5 | 22.3 | 0.7 |
| pKR2032-1 | 7.0 | 2.8 | 37.1 | 15.7 | 12.7 | 1.6 | 22.2 | 1.0 |
| pKR2032-6 | 6.9 | 2.7 | 36.4 | 15.3 | 13.1 | 1.7 | 23.2 | 0.8 |
| pKR2032-11 | 7.3 | 3.0 | 36.1 | 15.8 | 13.8 | 1.6 | 21.6 | 0.9 |
| Col-0 | 10.2 | 2.7 | 14.0 | 32.4 | 21.6 | 1.3 | 15.8 | 1.9 |

TABLE 19

Fatty acid profiles of lipid from bulk T2 seed samples for events transformed with pKR2033 expressing the 159-fad2b amiRNA

| Event | 16:0 | 18:0 | 18:1 | 18:2 | 18:3 | 20:0 | 20:1 | 20:2 |
|---|---|---|---|---|---|---|---|---|
| pKR2033-12 | 5.7 | 2.6 | 57.5 | 4.9 | 5.9 | 1.3 | 21.8 | 0.1 |
| pKR2033-13 | 6.8 | 2.7 | 56.8 | 6.6 | 7.3 | 1.2 | 18.3 | 0.2 |
| pKR2033-9 | 5.6 | 2.5 | 56.2 | 4.9 | 6.0 | 1.3 | 23.4 | 0.2 |
| pKR2033-6 | 5.7 | 2.5 | 55.1 | 5.5 | 6.6 | 1.3 | 22.9 | 0.2 |
| pKR2033-5 | 6.3 | 2.7 | 53.7 | 6.3 | 6.7 | 1.3 | 22.8 | 0.3 |
| pKR2033-8 | 6.9 | 2.8 | 48.5 | 9.4 | 8.6 | 1.4 | 21.9 | 0.5 |
| pKR2033-7 | 6.9 | 2.9 | 48.0 | 10.0 | 8.9 | 1.4 | 21.5 | 0.5 |
| pKR2033-3 | 6.7 | 2.7 | 46.3 | 11.0 | 9.0 | 1.4 | 22.4 | 0.6 |
| pKR2033-2 | 6.7 | 2.8 | 46.2 | 11.3 | 9.2 | 1.5 | 21.6 | 0.6 |

TABLE 19-continued

Fatty acid profiles of lipid from bulk T2 seed samples for events transformed with pKR2033 expressing the 159-fad2b amiRNA

| Event | 16:0 | 18:0 | 18:1 | 18:2 | 18:3 | 20:0 | 20:1 | 20:2 |
|---|---|---|---|---|---|---|---|---|
| pKR2033-10 | 6.9 | 2.8 | 42.3 | 12.6 | 10.9 | 1.6 | 22.2 | 0.7 |
| pKR2033-11 | 7.0 | 2.7 | 41.8 | 13.0 | 10.5 | 1.6 | 22.5 | 0.8 |
| pKR2033-1 | 6.9 | 2.7 | 39.3 | 14.5 | 11.4 | 1.6 | 22.7 | 0.9 |
| pKR2033-4 | 6.4 | 2.4 | 21.3 | 27.2 | 18.5 | 1.6 | 20.6 | 2.0 |
| Col-0 | 10.2 | 2.7 | 14.0 | 32.4 | 21.6 | 1.3 | 15.8 | 1.9 |

TABLE 20

Fatty acid profiles of lipid from bulk T2 seed samples for events transformed with pKR2034 expressing the 159-fad2c amiRNA

| Event | 16:0 | 18:0 | 18:1 | 18:2 | 18:3 | 20:0 | 20:1 | 20:2 |
|---|---|---|---|---|---|---|---|---|
| pKR2034-13 | 5.5 | 2.4 | 57.3 | 4.7 | 6.2 | 1.2 | 22.5 | 0.2 |
| pKR2034-2 | 5.9 | 2.6 | 56.6 | 5.2 | 6.3 | 1.2 | 22.1 | 0.2 |
| pKR2034-4 | 6.2 | 2.7 | 54.7 | 5.1 | 6.1 | 1.5 | 23.6 | 0.1 |
| pKR2034-1 | 7.0 | 2.9 | 47.7 | 9.3 | 8.2 | 1.6 | 23.0 | 0.3 |
| pKR2034-15 | 6.8 | 2.9 | 47.5 | 9.5 | 9.4 | 1.4 | 21.9 | 0.5 |
| pKR2034-5 | 7.0 | 3.0 | 46.3 | 11.0 | 9.3 | 1.5 | 21.2 | 0.6 |
| pKR2034-6 | 6.6 | 2.9 | 45.5 | 10.8 | 9.8 | 1.4 | 22.3 | 0.6 |
| pKR2034-14 | 6.4 | 2.7 | 45.2 | 10.9 | 9.4 | 1.6 | 23.1 | 0.6 |
| pKR2034-10 | 5.8 | 2.5 | 45.0 | 11.3 | 9.6 | 1.6 | 23.5 | 0.7 |
| pKR2034-9 | 6.8 | 2.8 | 45.0 | 11.1 | 9.6 | 1.6 | 22.6 | 0.5 |
| pKR2034-7 | 6.9 | 3.0 | 44.4 | 11.4 | 10.2 | 1.6 | 22.0 | 0.7 |
| pKR2034-17 | 6.9 | 2.8 | 43.3 | 12.3 | 9.9 | 1.6 | 22.4 | 0.6 |
| pKR2034-8 | 6.8 | 2.7 | 43.1 | 12.8 | 9.9 | 1.6 | 22.4 | 0.8 |
| pKR2034-11 | 7.0 | 2.9 | 42.6 | 13.7 | 10.4 | 1.6 | 21.0 | 0.7 |
| pKR2034-12 | 6.9 | 2.7 | 41.9 | 13.5 | 10.4 | 1.5 | 22.3 | 0.8 |
| pKR2034-16 | 6.5 | 2.8 | 40.3 | 14.5 | 11.0 | 1.8 | 22.2 | 0.8 |
| pKR2034-3 | 7.1 | 2.7 | 24.4 | 35.2 | 7.1 | 1.8 | 19.7 | 2.0 |
| Col-0 | 10.2 | 2.7 | 14.0 | 32.4 | 21.6 | 1.3 | 15.8 | 1.9 |

TABLE 21

Fatty acid profiles of lipid from bulk T2 seed samples for events transformed with pKR2037 expressing the 396b-fad2a amiRNA

| Event | 16:0 | 18:0 | 18:1 | 18:2 | 18:3 | 20:0 | 20:1 | 20:2 |
|---|---|---|---|---|---|---|---|---|
| pKR2037-12 | 6.4 | 2.6 | 43.4 | 12.5 | 10.1 | 1.5 | 22.8 | 0.7 |
| pKR2037-14 | 6.5 | 2.7 | 43.3 | 10.9 | 11.3 | 1.6 | 23.2 | 0.5 |
| pKR2037-7 | 6.8 | 2.9 | 43.2 | 12.6 | 11.0 | 1.5 | 21.4 | 0.6 |
| pKR2037-9 | 6.8 | 2.9 | 43.0 | 10.3 | 12.9 | 1.5 | 22.3 | 0.3 |
| pKR2037-11 | 7.2 | 2.8 | 38.0 | 14.6 | 13.2 | 1.5 | 21.8 | 0.7 |
| pKR2037-10 | 7.1 | 2.9 | 36.6 | 15.1 | 13.6 | 1.5 | 22.5 | 0.8 |
| pKR2037-2 | 6.5 | 2.7 | 36.6 | 14.3 | 14.1 | 1.6 | 23.7 | 0.6 |
| pKR2037-13 | 7.2 | 2.9 | 36.2 | 15.7 | 13.3 | 1.7 | 22.3 | 0.8 |
| pKR2037-5 | 6.5 | 2.8 | 36.0 | 14.6 | 15.8 | 1.5 | 22.2 | 0.6 |
| pKR2037-8 | 7.3 | 2.7 | 36.0 | 15.0 | 14.5 | 1.5 | 22.3 | 0.8 |
| pKR2037-6 | 6.7 | 2.7 | 33.5 | 17.1 | 14.7 | 1.5 | 23.0 | 0.8 |
| pKR2037-1 | 7.4 | 2.9 | 33.5 | 18.1 | 14.7 | 1.7 | 20.8 | 0.9 |
| pKR2037-3 | 6.9 | 2.7 | 25.5 | 22.5 | 18.0 | 1.6 | 21.6 | 1.2 |
| pKR2037-4 | 7.2 | 2.8 | 22.1 | 24.7 | 18.1 | 1.6 | 21.8 | 1.5 |
| pKR2037-15 | 7.9 | 3.0 | 19.0 | 26.5 | 20.0 | 1.8 | 20.0 | 1.7 |
| Col-0 | 10.2 | 2.7 | 14.0 | 32.4 | 21.6 | 1.3 | 15.8 | 1.9 |

TABLE 22

Fatty acid profiles of lipid from bulk T2 seed samples for events transformed with pKR2038 expressing the 396b-fad2b amiRNA

| Event | 16:0 | 18:0 | 18:1 | 18:2 | 18:3 | 20:0 | 20:1 | 20:2 |
|---|---|---|---|---|---|---|---|---|
| pKR2038-7 | 6.7 | 2.4 | 55.8 | 3.8 | 7.0 | 1.1 | 23.0 | 0.1 |
| pKR2038-12 | 5.9 | 2.6 | 51.2 | 6.7 | 9.8 | 1.3 | 22.2 | 0.3 |
| pKR2038-11 | 6.9 | 2.9 | 48.4 | 8.1 | 10.0 | 1.3 | 22.2 | 0.3 |
| pKR2038-5 | 6.8 | 2.7 | 47.2 | 10.5 | 9.2 | 1.3 | 21.8 | 0.6 |
| pKR2038-4 | 6.8 | 2.8 | 47.0 | 8.6 | 10.3 | 1.6 | 22.5 | 0.5 |
| pKR2038-6 | 7.1 | 2.6 | 46.9 | 9.5 | 10.6 | 1.4 | 21.4 | 0.5 |
| pKR2038-2 | 7.0 | 3.0 | 45.5 | 10.5 | 10.6 | 1.5 | 21.3 | 0.6 |
| pKR2038-9 | 7.1 | 2.6 | 45.0 | 11.6 | 10.4 | 1.2 | 21.5 | 0.6 |
| pKR2038-15 | 6.9 | 2.5 | 44.8 | 10.9 | 10.8 | 1.5 | 21.9 | 0.6 |
| pKR2038-13 | 7.1 | 2.8 | 44.1 | 12.0 | 11.0 | 1.3 | 21.0 | 0.7 |
| pKR2038-8 | 7.0 | 2.7 | 42.4 | 12.9 | 11.5 | 1.5 | 21.3 | 0.7 |
| pKR2038-1 | 7.2 | 2.8 | 39.7 | 13.3 | 12.4 | 1.5 | 22.3 | 0.9 |
| pKR2038-10 | 7.1 | 2.9 | 39.5 | 11.6 | 16.0 | 1.4 | 21.2 | 0.4 |
| pKR2038-3 | 6.9 | 2.7 | 27.5 | 22.2 | 17.3 | 1.6 | 20.7 | 1.1 |
| pKR2038-16 | 8.5 | 2.8 | 19.3 | 25.5 | 20.9 | 1.7 | 19.7 | 1.6 |
| pKR2038-14 | 8.3 | 2.8 | 14.9 | 28.7 | 21.8 | 1.8 | 19.6 | 2.1 |
| Col-0 | 10.2 | 2.7 | 14.0 | 32.4 | 21.6 | 1.3 | 15.8 | 1.9 |

TABLE 23

Fatty acid profiles of lipid from bulk T2 seed samples for events transformed with pKR2039 expressing the 396b-fad2c amiRNA

| Event | 16:0 | 18:0 | 18:1 | 18:2 | 18:3 | 20:0 | 20:1 | 20:2 |
|---|---|---|---|---|---|---|---|---|
| pKR2039-4 | 6.7 | 2.8 | 55.5 | 4.7 | 6.8 | 1.3 | 22.0 | 0.1 |
| pKR2039-14 | 6.6 | 2.9 | 54.1 | 6.4 | 7.4 | 1.3 | 21.1 | 0.2 |
| pKR2039-5 | 6.2 | 2.5 | 54.0 | 5.3 | 6.9 | 1.4 | 23.5 | 0.2 |
| pKR2039-8 | 6.7 | 2.9 | 53.3 | 6.8 | 7.4 | 1.4 | 21.2 | 0.3 |
| pKR2039-11 | 6.7 | 2.6 | 49.4 | 8.3 | 8.7 | 1.4 | 22.5 | 0.4 |
| pKR2039-3 | 6.2 | 2.4 | 48.9 | 9.6 | 9.5 | 1.1 | 21.8 | 0.5 |
| pKR2039-13 | 6.6 | 2.6 | 48.8 | 10.3 | 8.8 | 1.2 | 21.1 | 0.6 |
| pKR2039-7 | 6.9 | 2.6 | 43.6 | 11.2 | 10.7 | 1.5 | 22.9 | 0.7 |
| pKR2039-1 | 7.2 | 2.7 | 43.1 | 12.1 | 11.2 | 1.5 | 21.5 | 0.7 |
| pKR2039-9 | 6.9 | 2.7 | 42.7 | 12.6 | 11.8 | 1.3 | 21.3 | 0.8 |
| pKR2039-10 | 7.1 | 2.8 | 42.2 | 11.4 | 12.9 | 1.4 | 21.5 | 0.5 |
| pKR2039-2 | 7.5 | 2.8 | 39.8 | 14.0 | 12.8 | 1.5 | 21.0 | 0.6 |
| pKR2039-12 | 7.6 | 2.9 | 31.4 | 18.0 | 16.5 | 1.6 | 21.2 | 0.9 |
| pKR2039-6 | 7.8 | 2.9 | 22.2 | 23.7 | 20.1 | 1.7 | 20.0 | 1.6 |
| Col-0 | 10.2 | 2.7 | 14.0 | 32.4 | 21.6 | 1.3 | 15.8 | 1.9 |

TABLE 24

Fatty acid profiles of lipid from bulk T2 seed samples for events transformed with pKR2035 expressing the 159-fad3a amiRNA

| Event | 16:0 | 18:0 | 18:1 | 18:2 | 18:3 | 20:0 | 20:1 | 20:2 |
|---|---|---|---|---|---|---|---|---|
| pKR2035-15 | 8.0 | 2.6 | 16.8 | 45.4 | 2.7 | 1.7 | 20.0 | 2.7 |
| pKR2035-8 | 8.1 | 2.8 | 15.6 | 46.7 | 3.0 | 1.9 | 19.2 | 2.7 |
| pKR2035-9 | 7.5 | 2.6 | 18.3 | 44.0 | 3.3 | 1.7 | 20.1 | 2.4 |
| pKR2035-10 | 8.4 | 3.0 | 15.7 | 43.9 | 5.8 | 2.0 | 18.7 | 2.6 |
| pKR2035-7 | 8.3 | 2.8 | 16.6 | 42.1 | 6.3 | 1.9 | 19.5 | 2.5 |
| pKR2035-6 | 8.3 | 3.0 | 16.0 | 42.5 | 6.9 | 1.9 | 18.9 | 2.5 |
| pKR2035-12 | 8.6 | 2.8 | 14.5 | 43.3 | 6.9 | 2.2 | 19.0 | 2.6 |
| pKR2035-14 | 7.9 | 2.9 | 16.8 | 42.1 | 7.1 | 1.9 | 18.9 | 2.4 |
| pKR2035-11 | 7.9 | 2.9 | 16.4 | 41.1 | 7.1 | 1.9 | 20.3 | 2.5 |
| pKR2035-16 | 8.5 | 3.0 | 16.4 | 41.3 | 7.4 | 1.9 | 19.0 | 2.4 |
| pKR2035-3 | 7.4 | 2.8 | 16.9 | 40.5 | 7.4 | 2.0 | 20.5 | 2.4 |
| pKR2035-13 | 7.8 | 2.9 | 17.0 | 40.7 | 7.9 | 2.0 | 19.5 | 2.2 |
| pKR2035-17 | 7.9 | 2.8 | 16.3 | 40.7 | 7.9 | 2.0 | 19.9 | 2.5 |
| pKR2035-5 | 8.0 | 2.9 | 16.3 | 41.0 | 8.0 | 1.9 | 19.5 | 2.4 |
| pKR2035-2 | 8.6 | 3.0 | 14.7 | 40.4 | 9.8 | 1.9 | 19.0 | 2.5 |
| pKR2035-1 | 6.9 | 2.3 | 18.2 | 34.6 | 13.1 | 1.7 | 21.0 | 2.1 |
| pKR2035-4 | 8.3 | 3.0 | 14.3 | 30.1 | 20.8 | 1.9 | 19.4 | 2.1 |
| Col-0 | 10.2 | 2.7 | 14.0 | 32.4 | 21.6 | 1.3 | 15.8 | 1.9 |

TABLE 25

Fatty acid profiles of lipid from bulk T2 seed samples for events transformed with pKR2036 expressing the 159-fad3b amiRNA

| Event | 16:0 | 18:0 | 18:1 | 18:2 | 18:3 | 20:0 | 20:1 | 20:2 |
|---|---|---|---|---|---|---|---|---|
| pKR2036-11 | 7.6 | 2.9 | 16.5 | 46.9 | 1.5 | 2.0 | 20.0 | 2.6 |
| pKR2036-3 | 7.8 | 2.8 | 17.3 | 46.6 | 1.5 | 1.7 | 19.8 | 2.5 |
| pKR2036-10 | 8.3 | 2.8 | 16.5 | 46.7 | 1.9 | 1.9 | 19.3 | 2.6 |
| pKR2036-18 | 8.1 | 2.9 | 17.4 | 46.5 | 2.1 | 1.7 | 19.0 | 2.4 |
| pKR2036-2 | 8.0 | 2.8 | 17.0 | 46.4 | 2.3 | 1.8 | 19.2 | 2.5 |
| pKR2036-12 | 8.2 | 2.9 | 16.6 | 45.8 | 2.4 | 1.8 | 19.7 | 2.6 |
| pKR2036-9 | 8.1 | 3.1 | 16.7 | 44.1 | 4.8 | 1.9 | 18.8 | 2.3 |
| pKR2036-4 | 8.2 | 2.7 | 16.0 | 43.3 | 5.3 | 1.8 | 20.1 | 2.6 |
| pKR2036-13 | 8.3 | 3.0 | 15.9 | 44.5 | 5.6 | 1.7 | 18.4 | 2.5 |
| pKR2036-15 | 8.3 | 2.8 | 15.0 | 44.4 | 5.6 | 1.9 | 19.2 | 2.7 |
| pKR2036-1 | 8.0 | 2.9 | 15.7 | 44.0 | 5.9 | 1.9 | 19.1 | 2.5 |
| pKR2036-17 | 8.3 | 2.9 | 15.5 | 43.8 | 5.9 | 1.9 | 19.0 | 2.7 |
| pKR2036-5 | 8.3 | 2.9 | 15.5 | 43.5 | 6.1 | 2.0 | 19.3 | 2.6 |
| pKR2036-14 | 7.3 | 2.4 | 17.8 | 42.7 | 6.2 | 1.5 | 19.9 | 2.3 |
| pKR2036-8 | 8.2 | 2.7 | 16.1 | 41.4 | 7.2 | 1.7 | 20.1 | 2.5 |
| pKR2036-7 | 8.2 | 3.0 | 15.4 | 42.7 | 7.5 | 1.8 | 18.9 | 2.5 |
| pKR2036-16 | 8.1 | 2.7 | 14.6 | 41.7 | 8.1 | 1.7 | 20.3 | 2.7 |
| pKR2036-6 | 7.6 | 2.6 | 17.2 | 37.5 | 10.9 | 1.7 | 20.3 | 2.2 |
| Col-0 | 10.2 | 2.7 | 14.0 | 32.4 | 21.6 | 1.3 | 15.8 | 1.9 |

TABLE 26

Fatty acid profiles of lipid from bulk T2 seed samples for events transformed with pKR2040 expressing the 396b-fad3a amiRNA

| Event | 16:0 | 18:0 | 18:1 | 18:2 | 18:3 | 20:0 | 20:1 | 20:2 |
|---|---|---|---|---|---|---|---|---|
| pKR2040-14 | 8.6 | 2.9 | 15.1 | 47.9 | 2.4 | 1.8 | 18.6 | 2.8 |
| pKR2040-8 | 8.8 | 2.9 | 16.0 | 48.0 | 2.4 | 1.7 | 17.8 | 2.5 |
| pKR2040-17 | 8.4 | 2.8 | 16.5 | 46.3 | 2.8 | 1.8 | 18.8 | 2.6 |
| pKR2040-3 | 8.1 | 2.8 | 16.7 | 46.1 | 2.9 | 1.8 | 19.1 | 2.5 |
| pKR2040-16 | 8.5 | 2.7 | 15.4 | 47.4 | 3.1 | 1.7 | 18.5 | 2.6 |
| pKR2040-10 | 8.5 | 2.9 | 15.8 | 46.3 | 3.8 | 1.8 | 18.5 | 2.5 |
| pKR2040-2 | 8.6 | 2.9 | 16.5 | 45.9 | 4.1 | 1.7 | 17.9 | 2.4 |
| pKR2040-13 | 8.3 | 2.8 | 16.7 | 43.7 | 5.6 | 1.8 | 18.7 | 2.4 |
| pKR2040-5 | 8.2 | 2.7 | 16.2 | 42.3 | 6.5 | 1.7 | 19.8 | 2.5 |
| pKR2040-9 | 8.3 | 2.8 | 16.3 | 42.5 | 6.8 | 1.8 | 19.0 | 2.4 |
| pKR2040-15 | 8.3 | 2.9 | 16.2 | 42.5 | 7.1 | 2.0 | 18.5 | 2.5 |
| pKR2040-1 | 8.3 | 2.7 | 18.5 | 41.3 | 7.3 | 1.6 | 18.2 | 2.1 |
| pKR2040-11 | 8.5 | 2.8 | 15.9 | 42.6 | 7.4 | 1.6 | 18.7 | 2.4 |
| pKR2040-6 | 8.4 | 2.9 | 15.2 | 42.9 | 7.6 | 1.8 | 18.7 | 2.5 |
| pKR2040-7 | 7.5 | 2.5 | 16.8 | 40.9 | 8.6 | 1.8 | 19.5 | 2.4 |
| pKR2040-4 | 7.9 | 2.8 | 16.5 | 40.9 | 8.8 | 1.8 | 19.0 | 2.3 |
| pKR2040-12 | 8.0 | 2.8 | 15.2 | 34.3 | 16.4 | 1.7 | 19.4 | 2.2 |
| Col-0 | 10.2 | 2.7 | 14.0 | 32.4 | 21.6 | 1.3 | 15.8 | 1.9 |

TABLE 27

Fatty acid profiles of lipid from bulk T2 seed samples for events transformed with pKR2041 expressing the 396b-fad3b amiRNA

| Event | 16:0 | 18:0 | 18:1 | 18:2 | 18:3 | 20:0 | 20:1 | 20:2 |
|---|---|---|---|---|---|---|---|---|
| pKR2040-14 | 8.6 | 2.9 | 15.1 | 47.9 | 2.4 | 1.8 | 18.6 | 2.8 |
| pKR2041-4 | 8.2 | 2.8 | 16.8 | 46.8 | 2.3 | 1.8 | 18.8 | 2.5 |
| pKR2041-2 | 8.1 | 2.8 | 16.9 | 45.6 | 3.3 | 1.9 | 19.1 | 2.4 |
| pKR2041-11 | 8.0 | 2.8 | 15.9 | 45.6 | 3.8 | 1.9 | 19.4 | 2.5 |
| pKR2041-7 | 8.5 | 2.9 | 15.5 | 45.7 | 4.8 | 1.7 | 18.3 | 2.5 |
| pKR2041-1 | 8.4 | 2.8 | 16.1 | 44.8 | 5.8 | 1.7 | 18.0 | 2.4 |
| pKR2041-6 | 8.6 | 2.7 | 16.4 | 43.5 | 6.1 | 1.7 | 18.7 | 2.3 |
| pKR2041-8 | 8.2 | 2.9 | 16.9 | 42.3 | 6.4 | 1.7 | 19.2 | 2.4 |
| pKR2041-10 | 7.8 | 2.6 | 17.9 | 41.9 | 6.5 | 1.8 | 19.3 | 2.2 |
| pKR2041-5 | 7.6 | 2.5 | 15.6 | 44.2 | 7.0 | 1.7 | 18.7 | 2.7 |
| pKR2041-3 | 8.7 | 2.9 | 15.5 | 43.6 | 7.2 | 1.9 | 17.9 | 2.4 |
| pKR2041-9 | 8.3 | 2.8 | 17.1 | 42.0 | 7.3 | 1.9 | 18.5 | 2.2 |
| Col-0 | 10.2 | 2.7 | 14.0 | 32.4 | 21.6 | 1.3 | 15.8 | 1.9 |

TABLE 28

Fatty acid profiles of lipid from bulk T2 seed samples for events transformed with pKR2076 expressing the 159-faela amiRNA

| Event | 16:0 | 18:0 | 18:1 | 18:2 | 18:3 | 20:0 | 20:1 | 20:2 |
|---|---|---|---|---|---|---|---|---|
| pKR2076-13 | 8.4 | 2.2 | 32.0 | 49.5 | 6.3 | 0.5 | 1.1 | 0.0 |
| pKR2076-12 | 8.9 | 2.4 | 31.4 | 49.3 | 5.4 | 0.5 | 2.1 | 0.0 |
| pKR2076-2 | 8.6 | 2.6 | 31.6 | 49.0 | 4.9 | 0.6 | 2.7 | 0.0 |
| pKR2076-15 | 8.9 | 2.2 | 31.4 | 47.1 | 6.9 | 0.5 | 3.0 | 0.0 |
| pKR2076-9 | 9.4 | 2.8 | 28.2 | 47.9 | 8.3 | 0.0 | 3.4 | 0.0 |
| pKR2076-6 | 8.9 | 2.4 | 30.4 | 48.3 | 5.7 | 0.6 | 3.5 | 0.3 |
| pKR2076-4 | 8.2 | 2.4 | 32.4 | 47.4 | 5.1 | 0.6 | 3.7 | 0.3 |
| pKR2076-14 | 8.5 | 2.4 | 30.3 | 47.1 | 7.4 | 0.5 | 3.7 | 0.0 |
| pKR2076-11 | 8.6 | 2.5 | 29.6 | 47.6 | 7.2 | 0.6 | 3.9 | 0.0 |
| pKR2076-3 | 8.6 | 2.8 | 29.3 | 42.7 | 10.5 | 0.7 | 4.9 | 0.4 |
| pKR2076-10 | 8.8 | 2.5 | 28.0 | 46.3 | 8.1 | 0.6 | 5.3 | 0.5 |
| pKR2076-1 | 8.7 | 2.4 | 29.4 | 45.2 | 7.9 | 0.7 | 5.4 | 0.5 |
| pKR2076-7 | 9.0 | 2.7 | 27.6 | 42.4 | 11.2 | 0.7 | 5.8 | 0.5 |
| pKR2076-5 | 9.0 | 2.6 | 27.5 | 42.1 | 11.6 | 0.7 | 5.9 | 0.5 |
| pKR2076-8 | 9.1 | 2.6 | 26.3 | 43.5 | 10.9 | 0.7 | 6.3 | 0.6 |
| Col-0 | 10.2 | 2.7 | 14.0 | 32.4 | 21.6 | 1.3 | 15.8 | 1.9 |

TABLE 29

Fatty acid profiles of lipid from bulk T2 seed samples for events transformed with pKR2077 expressing the 159-faela amiRNA

| Event | 16:0 | 18:0 | 18:1 | 18:2 | 18:3 | 20:0 | 20:1 | 20:2 |
|---|---|---|---|---|---|---|---|---|
| pKR2077-12 | 8.1 | 2.6 | 30.5 | 34.9 | 21.6 | 0.5 | 1.6 | 0.2 |
| pKR2077-14 | 9.3 | 2.6 | 27.9 | 36.7 | 20.4 | 0.6 | 2.2 | 0.2 |
| pKR2077-2 | 9.4 | 2.9 | 25.6 | 37.7 | 21.3 | 0.6 | 2.3 | 0.2 |
| pKR2077-1 | 9.1 | 3.1 | 25.0 | 37.1 | 21.8 | 0.6 | 3.1 | 0.3 |
| pKR2077-7 | 9.4 | 2.8 | 23.3 | 37.2 | 21.6 | 0.6 | 4.6 | 0.4 |
| pKR2077-9 | 9.6 | 2.8 | 22.8 | 36.0 | 23.1 | 0.6 | 4.6 | 0.5 |
| pKR2077-3 | 9.1 | 2.7 | 24.0 | 36.3 | 22.2 | 0.6 | 4.6 | 0.5 |
| pKR2077-8 | 9.6 | 2.8 | 23.5 | 35.6 | 22.1 | 0.7 | 5.2 | 0.5 |
| pKR2077-10 | 8.8 | 2.5 | 25.2 | 35.2 | 21.1 | 0.8 | 5.9 | 0.6 |
| pKR2077-4 | 9.0 | 3.0 | 24.2 | 35.1 | 21.2 | 0.7 | 6.1 | 0.6 |
| pKR2077-13 | 9.8 | 2.8 | 21.1 | 36.5 | 21.8 | 0.8 | 6.5 | 0.7 |
| pKR2077-11 | 9.0 | 3.0 | 23.3 | 35.3 | 20.9 | 0.8 | 6.9 | 0.7 |
| Col-0 | 10.2 | 2.7 | 14.0 | 32.4 | 21.6 | 1.3 | 15.8 | 1.9 |

TABLE 30

Fatty acid profiles of lipid from bulk T2 seed samples for events transformed with pKR2078 expressing the 159-faelc amiRNA

| Event | 16:0 | 18:0 | 18:1 | 18:2 | 18:3 | 20:0 | 20:1 | 20:2 |
|---|---|---|---|---|---|---|---|---|
| pKR2078-7 | 9.0 | 2.5 | 29.6 | 36.1 | 20.5 | 0.4 | 1.8 | 0.0 |
| pKR2078-3 | 9.1 | 2.5 | 30.3 | 36.8 | 19.3 | 0.0 | 1.9 | 0.0 |
| pKR2078-10 | 8.7 | 2.3 | 29.8 | 37.1 | 19.6 | 0.5 | 2.0 | 0.0 |
| pKR2078-11 | 8.2 | 2.2 | 31.7 | 37.6 | 17.7 | 0.5 | 2.0 | 0.0 |
| pKR2078-13 | 9.1 | 2.6 | 29.5 | 38.1 | 18.2 | 0.5 | 2.1 | 0.0 |
| pKR2078-8 | 8.6 | 2.2 | 32.2 | 38.1 | 15.4 | 0.5 | 2.9 | 0.0 |
| pKR2078-4 | 8.6 | 1.9 | 26.2 | 35.1 | 23.9 | 0.6 | 3.6 | 0.0 |
| pKR2078-12 | 8.9 | 2.7 | 29.2 | 36.7 | 18.6 | 0.0 | 3.9 | 0.0 |
| pKR2078-14 | 9.2 | 2.5 | 27.7 | 37.1 | 19.0 | 0.6 | 4.0 | 0.0 |
| pKR2078-9 | 8.9 | 2.6 | 26.8 | 37.1 | 18.8 | 0.6 | 4.8 | 0.4 |
| pKR2078-1 | 8.3 | 2.6 | 28.5 | 36.9 | 17.1 | 0.7 | 5.6 | 0.5 |
| pKR2078-5 | 8.5 | 2.6 | 28.3 | 37.3 | 16.6 | 0.7 | 5.7 | 0.4 |
| pKR2078-2 | 9.4 | 2.9 | 26.7 | 34.4 | 19.1 | 0.8 | 6.0 | 0.6 |
| pKR2078-6 | 9.1 | 2.6 | 22.9 | 34.8 | 18.5 | 1.0 | 10.1 | 1.0 |
| Col-0 | 10.2 | 2.7 | 14.0 | 32.4 | 21.6 | 1.3 | 15.8 | 1.9 |

TABLE 31

Fatty acid profiles of lipid from bulk T2 seed samples for events transformed with pKR2079 expressing the 396b-faela amiRNA

| Event | 16:0 | 18:0 | 18:1 | 18:2 | 18:3 | 20:0 | 20:1 | 20:2 |
|---|---|---|---|---|---|---|---|---|
| pKR2079-9 | 8.8 | 2.3 | 29.6 | 47.4 | 10.4 | 0.0 | 1.5 | 0.0 |
| pKR2079-6 | 9.5 | 2.8 | 28.4 | 44.3 | 12.7 | 0.0 | 2.2 | 0.0 |
| pKR2079-15 | 8.7 | 2.6 | 29.7 | 45.9 | 10.2 | 0.5 | 2.4 | 0.0 |
| pKR2079-1 | 8.4 | 2.6 | 29.0 | 43.7 | 13.1 | 0.5 | 2.7 | 0.0 |
| pKR2079-4 | 10.3 | 2.3 | 28.1 | 44.7 | 10.6 | 0.5 | 3.4 | 0.0 |
| pKR2079-12 | 10.4 | 2.9 | 26.5 | 41.0 | 15.5 | 0.0 | 3.9 | 0.0 |
| pKR2079-10 | 9.9 | 2.7 | 26.0 | 41.9 | 15.4 | 0.0 | 4.0 | 0.0 |
| pKR2079-14 | 9.4 | 2.7 | 23.9 | 40.2 | 17.2 | 0.7 | 5.4 | 0.5 |
| pKR2079-7 | 8.7 | 2.4 | 29.2 | 42.7 | 11.6 | 0.0 | 5.4 | 0.0 |
| pKR2079-13 | 8.7 | 2.9 | 27.6 | 43.1 | 10.8 | 0.7 | 5.7 | 0.5 |
| pKR2079-8 | 9.5 | 2.4 | 23.9 | 39.6 | 18.2 | 0.0 | 6.4 | 0.0 |
| pKR2079-2 | 8.2 | 2.4 | 28.1 | 40.2 | 13.4 | 0.6 | 6.4 | 0.6 |
| pKR2079-3 | 9.0 | 2.5 | 25.8 | 39.9 | 15.1 | 0.7 | 6.5 | 0.6 |
| pKR2079-5 | 8.9 | 2.6 | 25.9 | 43.4 | 11.4 | 0.8 | 6.5 | 0.5 |
| pKR2079-11 | 9.0 | 2.5 | 19.4 | 34.6 | 17.4 | 0.0 | 15.7 | 1.4 |
| Col-0 | 10.2 | 2.7 | 14.0 | 32.4 | 21.6 | 1.3 | 15.8 | 1.9 |

TABLE 32

Fatty acid profiles of lipid from bulk T2 seed samples for events transformed with pKR2081 expressing the 396b-faelb amiRNA

| Event | 16:0 | 18:0 | 18:1 | 18:2 | 18:3 | 20:0 | 20:1 | 20:2 |
|---|---|---|---|---|---|---|---|---|
| pKR2081-1 | 9.3 | 2.8 | 28.7 | 36.7 | 20.5 | 0.5 | 1.6 | 0.0 |
| pKR2081-5 | 9.1 | 2.7 | 29.7 | 37.9 | 18.3 | 0.5 | 1.8 | 0.0 |
| pKR2081-14 | 8.3 | 2.7 | 29.8 | 36.3 | 19.1 | 0.5 | 3.3 | 0.0 |
| pKR2081-3 | 8.9 | 2.7 | 26.8 | 36.4 | 20.1 | 0.6 | 4.5 | 0.0 |
| pKR2081-9 | 9.0 | 2.9 | 18.0 | 33.4 | 17.6 | 1.4 | 16.2 | 1.6 |
| pKR2081-11 | 8.8 | 2.6 | 18.5 | 33.3 | 17.4 | 1.2 | 16.7 | 1.5 |
| pKR2081-7 | 8.3 | 2.8 | 18.5 | 33.0 | 17.7 | 1.3 | 16.7 | 1.6 |
| pKR2081-13 | 8.9 | 2.7 | 17.5 | 32.2 | 18.7 | 1.2 | 17.3 | 1.6 |
| pKR2081-12 | 8.9 | 2.4 | 17.4 | 32.8 | 18.2 | 1.3 | 17.5 | 1.6 |
| pKR2081-2 | 8.9 | 2.5 | 16.3 | 33.5 | 18.3 | 1.2 | 17.7 | 1.6 |
| pKR2081-6 | 8.0 | 2.7 | 18.5 | 32.2 | 18.1 | 1.3 | 17.7 | 1.5 |
| pKR2081-8 | 9.1 | 2.6 | 16.8 | 33.2 | 17.5 | 1.3 | 17.8 | 1.6 |
| pKR2081-4 | 8.2 | 2.7 | 17.8 | 32.5 | 17.7 | 1.3 | 18.2 | 1.6 |
| pKR2081-10 | 8.0 | 2.3 | 18.0 | 32.1 | 18.4 | 1.2 | 18.3 | 1.6 |
| Col-0 | 10.2 | 2.7 | 14.0 | 32.4 | 21.6 | 1.3 | 15.8 | 1.9 |

TABLE 33

Fatty acid profiles of lipid from bulk T2 seed samples for events transformed with pKR2080 expressing the 396b-faelc amiRNA

| Event | 16:0 | 18:0 | 18:1 | 18:2 | 18:3 | 20:0 | 20:1 | 20:2 |
|---|---|---|---|---|---|---|---|---|
| pKR2080-10 | 8.7 | 2.5 | 30.0 | 39.9 | 17.0 | 0.5 | 1.5 | 0.0 |
| pKR2080-5 | 8.7 | 2.5 | 30.9 | 37.2 | 18.7 | 0.5 | 1.5 | 0.0 |
| pKR2080-2 | 9.3 | 2.7 | 28.7 | 36.7 | 20.4 | 0.5 | 1.8 | 0.0 |
| pKR2080-15 | 9.5 | 2.7 | 27.1 | 37.7 | 19.5 | 0.5 | 2.9 | 0.0 |
| pKR2080-3 | 8.9 | 2.8 | 28.5 | 37.3 | 18.8 | 0.6 | 3.1 | 0.0 |
| pKR2080-6 | 8.9 | 2.7 | 26.9 | 36.9 | 20.4 | 0.5 | 3.4 | 0.3 |
| pKR2080-13 | 9.2 | 2.6 | 26.5 | 37.6 | 18.4 | 0.6 | 4.6 | 0.5 |
| pKR2080-1 | 8.9 | 2.6 | 27.0 | 37.0 | 18.6 | 0.7 | 4.9 | 0.5 |
| pKR2080-16 | 8.7 | 2.7 | 26.7 | 37.1 | 18.7 | 0.6 | 5.1 | 0.4 |
| pKR2080-4 | 8.3 | 2.5 | 28.2 | 35.7 | 18.9 | 0.6 | 5.3 | 0.4 |
| pKR2080-8 | 8.1 | 2.7 | 27.8 | 36.5 | 18.4 | 0.6 | 5.5 | 0.4 |
| pKR2080-14 | 8.5 | 2.5 | 27.1 | 36.8 | 18.4 | 0.7 | 5.5 | 0.5 |
| pKR2080-11 | 8.5 | 2.5 | 27.5 | 36.4 | 18.3 | 0.6 | 5.7 | 0.5 |
| pKR2080-9 | 9.2 | 2.7 | 25.4 | 36.8 | 18.5 | 0.7 | 6.2 | 0.6 |
| pKR2080-12 | 8.8 | 2.5 | 24.6 | 36.5 | 19.1 | 0.7 | 7.2 | 0.7 |
| pKR2080-7 | 8.6 | 2.4 | 25.0 | 35.9 | 17.2 | 0.8 | 9.3 | 0.9 |
| Col-0 | 10.2 | 2.7 | 14.0 | 32.4 | 21.6 | 1.3 | 15.8 | 1.9 |

It is clear from Tables 18 to 23 that events expressing fad2a, fad2b or fad2c amiRNAs in either the soy 159 or 396b precursor amiRNA backbone function to suppress fad2 and thus increase 18:1 content to as high as 57.5%, in bulk T2 seed, compared to 14.0% for the wild-type seed.

It is also evident from Tables 24 to 27 that events expressing fad3a or fad3b amiRNAs in either the soy 159 or 396b precursor amiRNA backbone function to suppress fad3 and thus decrease 18:3 to as low as 1.5%, in bulk T2 seed, compared to 21.6% for wild-type seed.

Tables 28 to 33 show that events expressing faeIa, faeIb or faeIc amiRNAs in either the soy 159 or 396b precursor amiRNA backbone function to suppress faeI and thus decrease 20:1 to as low as 1.1%, in bulk T2 seed, compared to 15.8% for wild-type seed.

Fatty Acid Analysis of Bulk T3 Seed from Homozygous Plants

All T2 events for all constructs were plated on Kanamycin as described above and those events where kanamycin resistant plants segregated from kanamycin sensitive plants by a ratio of 3:1, indicating a single copy insertion were analyzed for fatty acid profile in individual seed.

Individual seed were ground in 10 uL of TMSH, 20 uL of hexane was added and after 30 min, a portion of the heptanes phase was injected into the GC and FAMEs were analyzed as described above. Events where expected fatty acid phenotypes segregated 3:1 with wild-type phenotypes having the largest changes in fatty acid profiles compared to that from wild-type seed were advanced and plants were grown to obtain T3 seed.

T3 seed were plated on kanamycin plates as above and those that no longer segregated for kanamycin sensitive plants were considered homozygous and in those samples, T3 seed was analyzed for fatty acid profile in bulk as described above for T2 seed. Homozygous T3 seed was not obtained for pKR2079 or pKR2081 events. Also, the pKR2077 events were planted later than the others and therefore the T3 seed fatty acid profiles were not included here.

Results for fatty acid profiles for homozygous T3 seed batches for one representative event from each experiment are presented in Tables 34 to 36 below. In each Table, fatty acids are identified as 16:0 (palmitate), 18:0 (stearic acid), 18:1 (oleic acid), 18:2 (linoleic acid) and 18:3 (alpha-linolenic acid), 20:0 (eicosanoic acid), 20:1 eicosenoic acid) 20:2 (eicocadienoic acid) and 20:3 (eicosatrienoic acid) and results are expressed as a weight percent (wt. %) of total fatty acids. For constructs expressing a fad2 amiRNA, fatty acid profiles are sorted from highest 18:1 to lowest. For constructs expressing a fad3 amiRNA, fatty acids are sorted from lowest 18:3 to highest. For constructs expressing a faeI amiRNA, fatty acids are sorted from lowest to highest 20:1. A wild-type Columbia seed batch was also run and shown for comparison in each Table as col-0.

TABLE 34

Fatty acid profiles of lipid from bulk T3 seed samples for events transformed with pKR2032, pKR2033, pKR2034, pKR2037, pKR2038 or pKR2039 having amiRNAs to fad2

| Event | amiRNA | 16:0 | 18:0 | 18:1 | 18:2 | 18:3 | 20:0 | 20:1 | 20:2 |
|---|---|---|---|---|---|---|---|---|---|
| pKR2032-10-17 | 159-fad2a | 7.0 | 2.7 | 57.6 | 5.9 | 6.2 | 0.9 | 18.9 | 0.0 |
| pKR2032-10-10 | 159-fad2a | 6.9 | 2.7 | 55.5 | 6.4 | 6.8 | 1.0 | 19.4 | 0.2 |
| pKR2032-10-14 | 159-fad2a | 6.8 | 2.6 | 55.2 | 6.4 | 6.8 | 1.0 | 19.7 | 0.2 |
| pKR2033-8-2 | 159-fad2b | 7.3 | 2.5 | 59.4 | 4.7 | 5.9 | 0.9 | 18.2 | 0.1 |
| pKR2033-8-14 | 159-fad2b | 7.1 | 2.7 | 59.1 | 4.4 | 5.6 | 1.0 | 19.0 | 0.1 |
| pKR2033-8-9 | 159-fad2b | 7.1 | 2.7 | 58.8 | 4.6 | 5.7 | 1.0 | 19.1 | 0.1 |
| pKR2034-15-5 | 159-fad2c | 7.4 | 2.7 | 58.6 | 4.3 | 6.4 | 0.9 | 18.8 | 0.0 |
| pKR2034-15-3 | 159-fad2c | 7.2 | 2.8 | 58.2 | 4.4 | 5.9 | 1.1 | 19.5 | 0.0 |
| pKR2034-15-11 | 159-fad2c | 6.9 | 2.8 | 58.0 | 4.8 | 6.0 | 1.1 | 19.6 | 0.0 |
| pKR2037-12-15 | 396b-fad2a | 6.9 | 2.5 | 60.4 | 6.0 | 4.5 | 0.9 | 18.1 | 0.0 |
| pKR2037-12-9 | 396b-fad2a | 6.2 | 2.5 | 58.6 | 5.7 | 4.3 | 1.1 | 20.3 | 0.1 |
| pKR2037-12-11 | 396b-fad2a | 6.7 | 2.4 | 58.1 | 5.9 | 5.2 | 1.0 | 19.8 | 0.0 |
| pKR2038-4-10 | 396b-fad2b | 0.0 | 0.0 | 64.1 | 0.0 | 0.0 | 0.0 | 35.9 | 0.0 |
| pKR2038-4-9 | 396b-fad2b | 7.6 | 2.7 | 57.3 | 4.6 | 6.8 | 1.0 | 19.0 | 0.1 |
| pKR2038-4-6 | 396b-fad2b | 7.1 | 2.8 | 57.1 | 4.7 | 6.7 | 1.0 | 19.6 | 0.0 |
| pKR2039-11-4 | 396b-fad2c | 6.6 | 2.7 | 58.5 | 3.5 | 5.3 | 1.1 | 21.0 | 0.1 |
| pKR2039-11-15 | 396b-fad2c | 6.6 | 2.7 | 58.0 | 3.8 | 5.1 | 1.2 | 21.2 | 0.1 |
| pKR2039-11-14 | 396b-fad2c | 6.2 | 2.5 | 56.7 | 3.7 | 5.5 | 1.2 | 22.7 | 0.1 |
| Col-0 | | 10.2 | 2.7 | 14.0 | 32.4 | 21.6 | 1.3 | 15.8 | 1.9 |

TABLE 35

Fatty acid profiles of lipid from bulk T3 seed samples for events transformed with pKR2035, pKR2036, pKR2040 and pKR2041 having amiRNAs to fad3

| Event | amiRNA | 16:0 | 18:0 | 18:1 | 18:2 | 18:3 | 20:0 | 20:1 | 20:2 |
|---|---|---|---|---|---|---|---|---|---|
| pKR2035-7-15 | 159-fad3a | 9.8 | 2.7 | 19.3 | 48.9 | 1.7 | 1.1 | 14.1 | 1.8 |
| pKR2035-7-4 | 159-fad3a | 8.6 | 2.6 | 18.0 | 47.3 | 1.7 | 1.3 | 16.7 | 2.2 |
| pKR2035-7-9 | 159-fad3a | 8.7 | 2.6 | 17.9 | 48.3 | 1.7 | 1.3 | 16.3 | 2.1 |
| pKR2036-9-16 | 159-fad3b | 8.0 | 2.5 | 18.7 | 46.7 | 2.0 | 1.3 | 17.2 | 2.0 |
| pKR2036-9-17 | 159-fad3b | 7.8 | 2.3 | 17.9 | 46.8 | 2.2 | 1.3 | 17.7 | 2.2 |
| pKR2036-9-9 | 159-fad3b | 7.9 | 2.4 | 17.8 | 46.5 | 2.2 | 1.4 | 17.7 | 2.2 |
| pKR2040-16-13 | 396b-fad3a | 7.6 | 2.4 | 19.5 | 45.0 | 1.6 | 1.5 | 18.4 | 2.1 |
| pKR2040-16-12 | 396b-fad3a | 8.1 | 2.7 | 18.1 | 46.2 | 1.6 | 1.5 | 17.8 | 2.2 |
| pKR2040-16-3 | 396b-fad3a | 8.2 | 2.4 | 18.0 | 46.9 | 1.7 | 1.4 | 17.5 | 2.2 |
| pKR2041-7-11 | 396b-fad3b | 7.9 | 2.8 | 19.5 | 45.0 | 1.6 | 1.6 | 17.8 | 2.0 |
| pKR2041-7-3 | 396b-fad3b | 8.2 | 2.9 | 18.5 | 46.1 | 1.5 | 1.6 | 17.2 | 2.2 |
| pKR2041-7-8 | 396b-fad3b | 7.9 | 3.0 | 18.2 | 45.2 | 1.5 | 1.7 | 18.3 | 2.3 |
| Col-0 | | 10.2 | 2.7 | 14.0 | 32.4 | 21.6 | 1.3 | 15.8 | 1.9 |

TABLE 36

Fatty acid profiles of lipid from bulk T3 seed samples for events transformed with pKR2076, pKR2078 or pKR2080 having amiRNAs to fae1

| Event | amiRNA | 16:0 | 18:0 | 18:1 | 18:2 | 18:3 | 20:0 | 20:1 | 20:2 |
|---|---|---|---|---|---|---|---|---|---|
| pKR2076-15-7 | 159-fae1a | 10.5 | 2.5 | 30.2 | 50.4 | 4.8 | 0.4 | 1.1 | 0.0 |
| pKR2076-15-2 | 159-fae1a | 9.2 | 3.0 | 28.7 | 51.2 | 5.3 | 0.6 | 1.6 | 0.2 |
| pKR2076-15-1 | 159-fae1a | 9.3 | 2.9 | 28.5 | 51.3 | 5.3 | 0.6 | 1.6 | 0.2 |
| pKR2078-8-4 | 159-fae1c | 10.0 | 3.0 | 27.9 | 52.1 | 5.0 | 0.5 | 1.3 | 0.1 |
| pKR2080-5-10 | 396b-fae1c | 9.5 | 3.0 | 27.5 | 37.1 | 20.7 | 0.5 | 1.3 | 0.2 |
| Col-0 | | 10.2 | 2.7 | 14.0 | 32.4 | 21.6 | 1.3 | 15.8 | 1.9 |

It is clear from Table 34 that events expressing fad2a, fad2b or fad2c amiRNAs in either the soy 159 or 396b precursor amiRNA backbone function to suppress fad2 and thus increase 18:1 content to as high as 64.1%, in bulk homozygous T3 seed, compared to 14.0% for the wild-type seed.

It is also evident from Table 35 that events expressing fad3a or fad3b amiRNAs in either the soy 159 or 396b precursor amiRNA backbone function to suppress fad3 and thus decrease 18:3 to as low as 1.5%, in bulk homozygous T3 seed, compared to 21.6% for wild-type seed. Table 36 shows that events expressing fae1a or fae1c amiRNAs in the soy 159 precursor amiRNA or fae1c in the soy 396b precursor amiRNA backbone function to suppress fae1 and thus decrease 20:1 to as low as 1.1%, in bulk homozygous T3 seed, compared to 15.8% for wild-type seed.

Example 8

Constructs Expressing amiRNA Combinations for Silencing *Arabidopsis* and/or *Brassica* Fatty Acid Biosynthetic Genes From Table 17, the amiRNA precursors 159-Atfad2a (SEQ ID NO: 136), 159-Atfad2b (SEQ ID NO: 137), 159-Atfad2c (SEQ ID NO: 138), 159-Atfad3a (SEQ ID NO: 142), 159-Atfad3b (SEQ ID NO: 143), 159-Atfaela (SEQ ID NO: 146), 159-Atfaelb (SEQ ID NO: 147) and 159-Atfaelc (SEQ ID NO: 148) are 958 nt in length and are substantially similar to the deoxyribonucleotide sequence set forth in SEQ ID NO: 152 wherein nucleotides 276 to 296 of SEQ ID NO: 152 are replaced by the fad2a amiRNA (SEQ ID NO: 80), fad2b amiRNA (SEQ ID NO: 83), fad2c amiRNA (SEQ ID NO: 86), fad3a amiRNA (SEQ ID NO: 89), fad3b amiRNA (SEQ ID NO: 92), fae1a amiRNA (SEQ ID NO: 95), fae1b amiRNA (SEQ ID NO: 98) or fae1c amiRNA (SEQ ID NO: 101), respectively and wherein nucleotides 121 to 141 of SEQ ID NO: 152 are replaced by fad2a Star Sequence (SEQ ID NO: 81), fad2b Star Sequence (SEQ ID NO: 84), fad2c Star Sequence (SEQ ID NO: 87), fad3a Star Sequence (SEQ ID NO: 90), fad3b Star Sequence (SEQ ID NO: 93), fae1a Star Sequence (SEQ ID NO: 96), fae1b Star Sequence (SEQ ID NO: 99) or fae1c Star Sequence (SEQ ID NO: 102), respectively.

From Table 17, the amiRNA precursors 396b-Atfad2a (SEQ ID NO: 139), 396b-Atfad2b (SEQ ID NO: 140), 396b-Atfad2c (SEQ ID NO: 141), 396b-Atfad3a (SEQ ID NO: 144), 396b-Atfad2b (SEQ ID NO: 145), 396b-fae1a (SEQ ID NO: 149), 396b-fae1b (SEQ ID NO: 150) and 396b-fae1c (SEQ ID NO: 151) are 574 nt in length and are substantially similar to the deoxyribonucleotide sequence set forth in SEQ ID NO: 153 wherein nucleotides 196 to 216 of SEQ ID NO: 153 are replaced by the fad2a amiRNA (SEQ ID NO: 80), fad2b amiRNA (SEQ ID NO: 83), fad2c amiRNA (SEQ ID NO: 86), fad3a amiRNA (SEQ ID NO: 89), fad3b amiRNA (SEQ ID NO: 92), fae1a amiRNA (SEQ ID NO: 95), fae1b amiRNA (SEQ ID NO: 98) or fae1c amiRNA (SEQ ID NO: 101), respectively and wherein nucleotides 262 to 282 of SEQ ID NO: 153 are replaced by the fad2a Star Sequence (SEQ ID NO: 82), fad2b Star Sequence (SEQ ID NO: 85), fad2c Star Sequence (SEQ ID NO: 88), fad3a Star Sequence (SEQ ID NO: 91), fad3b Star Sequence (SEQ ID NO: 94), 396b-fae1a Star Sequence (SEQ ID NO: 97), 396b-fae1b Star Sequence (SEQ ID NO: 100) or 396b-fae1c Star Sequence (SEQ ID NO: 103), respectively.

Using cloning methods familiar to one skilled in the art (e.g. PCR, restriction enzyme digestion, etc.), individual amiRNA precursors targeting either fad2 and fad3, shown in Table 17, were combined together into a single transcriptional unit such that both amiRNA precursors were expressed together downstream of the single beta-conglycinin promoter. In some cases, a third amiRNA precursor targeting fae1 was also combined with the fad2 and fad3 amiRNA precursors to generate triple amiRNA units targeting all three genes. In each case, the full cassette including the beta-conglycinin promoter, the multiple amiRNA and the phaseolin transcription terminator were flanked by AscI sites to enable cloning into other expression vectors.

These plasmids were then digested with AscI and the fragment containing the amiRNA expression cassette was sub-cloned into the AscI site of expression vector pKR92, which was previously described in WO2007/06110109 (published on May 31, 2007, the contents of which are herein incorporated by reference).

The amiRNA combinations made and the corresponding expression vector sequences are described in Table 37.

TABLE 37

Precursor amiRNA combinations and amiRNA Expression Vectors For *Arabidopsis* and/or *Brassica* Fatty Acid Biosynthetic Gene Sequences Targeted for Silencing

| amiRNA Precursor | amiRNA Precursor SEQ ID NO | Plasmid Name | Plasmid SEQ ID NO |
|---|---|---|---|
| 159-Atfad2a/396b-Atfad3b amiRNA | 154 | pKR2232 | 155 |
| 159-Atfad2b/396b-Atfad3b amiRNA | 156 | pKR2233 | 157 |
| 396b-Atfad3b/159-Atfad2a amiRNA | 158 | pKR2234 | 159 |
| 396b-Atfad3b/159-Atfad2b amiRNA | 160 | pKR2235 | 161 |
| 159-Atfad2a/396b-Atfad3b/159-Atfae1a amiRNA | 162 | pKR2248 | 163 |
| 396b-Atfad3b/159-Atfad2a/159-fae1a amiRNA | 164 | pKR2249 | 165 |
| 159-Atfad2b/396b-Atfad3b/159-Atfae1a amiRNA | 166 | pKR2250 | 167 |
| 396b-Atfad3b/159-Atfad2b/159-Atfae1a amiRNA | 168 | pKR2251 | 169 |

From Table 37, the amiRNA precursor 159-Atfad2a/396b-Atfad3b (SEQ ID NO: 154), which combines amiRNA precursors 159-Atfad2a (SEQ ID NO: 136) and 396b-Atfad3b (SEQ ID NO: 143) into one transcriptional unit, is 1556 nt in length and is substantially similar to the deoxyribonucleotide sequence set forth in SEQ ID NO: 152 (from nt 16 to 974 of 159-Atfad2a/396b-Atfad3b) wherein nucleotides 276 to 296 of SEQ ID NO: 152 are replaced by 159-Atfad2a amiRNA (SEQ ID NO: 80) and wherein nucleotides 121 to 141 of SEQ ID NO: 152 are replaced by 159-Atfad2a amiRNA Star Sequence (SEQ ID NO: 81). The amiRNA precursor 159-Atfad2a/396b-Atfad3b (SEQ ID NO: 154) is also substantially similar to the deoxyribonucleotide sequence set forth in SEQ ID NO: 153 (from nt 982 to 1555 of 159-Atfad2a/396b-Atfad3b) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94).

From Table 37, the amiRNA precursor 159-Atfad2b/396b-Atfad3b (SEQ ID NO: 156), which combines amiRNA precursors 159-Atfad2b (SEQ ID NO: 137) and 396b-Atfad3b (SEQ ID NO: 143) into one transcriptional unit, is 1556 nt in length and is substantially similar to the deoxyribonucleotide sequence set forth in SEQ ID NO: 152 (from nt 16 to 974 of 159-Atfad2b/396b-Atfad3b) wherein nucleotides 276 to 296 of SEQ ID NO: 152 are replaced by 159-Atfad2b amiRNA (SEQ ID NO: 83) and wherein nucleotides 121 to 141 of SEQ ID NO: 152 are replaced by 159-Atfad2b amiRNA Star Sequence (SEQ ID NO: 84). The amiRNA precursor 159-Atfad2b/396b-Atfad3b (SEQ ID NO: 156) is also substantially similar to the deoxyribonucleotide sequence set forth in SEQ ID NO: 153 (from nt 982 to 1555 of 159-Atfad2b/396b-Atfad3b) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94).

From Table 37, the amiRNA precursor 396b-Atfad3b/159-Atfad2a (SEQ ID NO: 158), which combines amiRNA precursors and 396b-Atfad3b (SEQ ID NO: 143) and 159-Atfad2a (SEQ ID NO: 136) into one transcriptional unit, is 1556 nt in length and is substantially similar to the deoxyribonucleotide sequence set forth in SEQ ID NO: 153 (from nt 7 to 581 of 396b-Atfad3b/159-Atfad2a) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 396b-Atfad3b/159-Atfad2a (SEQ ID NO: 158) is also substantially similar to the deoxyribonucleotide sequence set forth in SEQ ID NO: 152 (from nt 588 to 1546 of 396b-Atfad3b/159-Atfad2a) wherein nucleotides 276 to 296 of SEQ ID NO: 152 are replaced by 159-Atfad2a amiRNA (SEQ ID NO: 80) and wherein nucleotides 121 to 141 of SEQ ID NO: 152 are replaced by 159-Atfad2a amiRNA Star Sequence (SEQ ID NO: 81).

From Table 37, the amiRNA precursor 396b-Atfad3b/159-Atfad2b (SEQ ID NO: 160), which combines amiRNA precursors and 396b-Atfad3b (SEQ ID NO: 143) and 159-Atfad2b (SEQ ID NO: 137) into one transcriptional unit, is 1556 nt in length and is substantially similar to the deoxyribonucleotide sequence set forth in SEQ ID NO: 153 (from nt 7 to 581 of 396b-Atfad3b/159-Atfad2b) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 396b-Atfad3b/159-Atfad2b (SEQ ID NO: 160) is also substantially similar to the deoxyribonucleotide sequence set forth in SEQ ID NO: 152 (from nt 588 to 1546 of 396b-Atfad3b/159-Atfad2b) wherein nucleotides 276 to 296 of SEQ ID NO: 152 are replaced by 159-Atfad2b amiRNA (SEQ ID NO: 83) and wherein nucleotides 121 to 141 of SEQ ID NO: 152 are replaced by 159-Atfad2b amiRNA Star Sequence (SEQ ID NO: 84).

From Table 37, the amiRNA precursor 159-Atfad2a/396b-Atfad3b/159-Atfae1a (SEQ ID NO: 162), which combines amiRNA precursors 159-Atfad2a (SEQ ID NO: 136), 396b-Atfad3b (SEQ ID NO: 143) and 159-Atfae1a (SEQ ID NO: 146) into one transcriptional unit, is 2530 nt in length and is substantially similar to the deoxyribonucleotide sequence set forth in SEQ ID NO: 152 (from nt 25 to 983 of 159-Atfad2a/396b-Atfad3b/159-Atfae1a) wherein nucleotides 276 to 296 of SEQ ID NO: 152 are replaced by 159-Atfad2a amiRNA (SEQ ID NO: 80) and wherein nucleotides 121 to 141 of SEQ ID NO: 152 are replaced by 159-Atfad2a amiRNA Star Sequence (SEQ ID NO: 81). The amiRNA precursor 159-Atfad2a/396b-Atfad3b/159-Atfae1a (SEQ ID NO: 162) is also substantially similar to the deoxyribonucleotide sequence set forth in SEQ ID NO: 153 (from nt 991 to 1564 of 159-Atfad2a/396b-Atfad3b/159-Atfae1a) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 159-Atfad2a/396b-Atfad3b/159-Atfae1a (SEQ ID NO: 162) is also substantially similar to the deoxyribonucleotide sequence set forth in SEQ ID NO: 152 (from nt 1571 to 2529 of 159-Atfad2a/396b-Atfad3b/159-Atfae1a) wherein nucleotides 276 to 296 of SEQ ID NO: 152 are replaced by 159-Atfae1a amiRNA (SEQ ID NO: 95) and wherein nucleotides 121 to 141 of SEQ ID NO: 152 are replaced by 159-Atfae1a amiRNA Star Sequence (SEQ ID NO: 96).

From Table 37, the amiRNA precursor 396b-Atfad3b/159-Atfad2a/159-Atfae1a (SEQ ID NO: 164), which combines amiRNA precursors and 396b-Atfad3b (SEQ ID NO: 143), 159-Atfad2a (SEQ ID NO: 136) and 159-Atfae1a (SEQ ID NO: 146) into one transcriptional unit, is 2530 nt in length and is substantially similar to the deoxyribonucleotide sequence set forth in SEQ ID NO: 153 (from nt 16 to 590 of 396b-Atfad3b/159-Atfad2a/159-Atfae1a) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 396b-Atfad3b/159-Atfad2a/159-Atfae1a (SEQ ID NO: 164) is also substantially similar to the deoxyribonucleotide sequence set forth in SEQ ID NO: 152 (from nt 597 to 1555 of 396b-Atfad3b/159-Atfad2a/159-Atfae1a) wherein nucleotides 276 to 296 of SEQ ID NO: 152 are replaced by 159-Atfad2a amiRNA (SEQ ID NO: 80) and wherein nucleotides 121 to 141 of SEQ ID NO: 152 are replaced by 159-Atfad2a amiRNA Star Sequence (SEQ ID NO: 81). The amiRNA precursor 396b-Atfad3b/159-Atfad2a/159-Atfae1a (SEQ ID NO: 164) is also substantially similar to the deoxyribonucleotide sequence set forth in SEQ ID NO: 152 (from nt 1571 to 2529 of 396b-Atfad3b/159-Atfad2a/159-Atfae1a) wherein nucleotides 276 to 296 of SEQ ID NO: 152 are replaced by 159-Atfae1a amiRNA (SEQ ID NO: 95) and wherein nucleotides 121 to 141 of SEQ ID NO: 152 are replaced by 159-Atfae1a amiRNA Star Sequence (SEQ ID NO: 96).

From Table 37, the amiRNA precursor 159-Atfad2b/396b-Atfad3b/159-Atfae1a (SEQ ID NO: 166), which combines amiRNA precursors 159-Atfad2b (SEQ ID NO: 137), 396b-Atfad3b (SEQ ID NO: 143) and 159-Atfae1a (SEQ ID NO: 146) into one transcriptional unit, is 2530 nt in length and is substantially similar to the deoxyribonucleotide sequence set forth in SEQ ID NO: 152 (from nt 25 to 983 of 159-Atfad2b/396b-Atfad3b/159-Atfae1a) wherein nucleotides 276 to 296 of SEQ ID NO: 152 are replaced by 159-Atfad2b amiRNA (SEQ ID NO: 83) and nucleotides 121 to 141 of SEQ ID NO: 152 are replaced by 159-Atfad2a amiRNA Star Sequence (SEQ ID NO: 84). The amiRNA precursor 159-Atfad2b/396b-Atfad3b/159-Atfae1a (SEQ ID NO: 166) is also substantially similar to the deoxyribonucleotide sequence set forth in SEQ ID NO: 153 (from nt 991 to 1564 of 159-Atfad2b/396b-Atfad3b/159-Atfae1a) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 159-Atfad2b/396b-Atfad3b/159-Atfae1a (SEQ ID NO: 166) is also substantially similar to the deoxyribonucleotide sequence set forth in SEQ ID NO: 152 (from nt 1571 to 2529 of 159-Atfad2b/396b-Atfad3b/159-Atfae1a) wherein nucleotides 276 to 296 of SEQ ID NO: 152 are replaced by 159-Atfae1a amiRNA (SEQ ID NO: 95) and wherein nucleotides 121 to 141 of SEQ ID NO: 152 are replaced by 159-Atfae1a amiRNA Star Sequence (SEQ ID NO: 96).

From Table 37, the amiRNA precursor 396b-Atfad3b/159-Atfad2b/159-Atfae1a (SEQ ID NO: 168), which combines amiRNA precursors and 396b-Atfad3b (SEQ ID NO: 143), 159-Atfad2b (SEQ ID NO: 137) and 159-Atfae1a (SEQ ID NO: 146) into one transcriptional unit, is 2530 nt in length and is substantially similar to the deoxyribonucleotide sequence set forth in SEQ ID NO: 153 (from nt 16 to 590 of 396b-Atfad3b/159-Atfad2b/159-Atfae1a) wherein nucleotides 196 to 216 of SEQ ID NO: 153 are replaced by 396b-Atfad3b amiRNA (SEQ ID NO: 92) and wherein nucleotides 262 to 282 of SEQ ID NO: 153 are replaced by 396b-Atfad3b amiRNA Star Sequence (SEQ ID NO: 94). The amiRNA precursor 396b-Atfad3b/159-Atfad2b/159-Atfae1a (SEQ ID NO: 168) is also substantially similar to the deoxyribonucleotide sequence set forth in SEQ ID NO: 152 (from nt 597 to 1555 of 396b-Atfad3b/159-Atfad2b/159-Atfae1a) wherein nucleotides 276 to 296 of SEQ ID NO: 152 are replaced by 159-Atfad2b amiRNA (SEQ ID NO: 83) and wherein nucleotides 121 to 141 of SEQ ID NO: 152 are replaced by 159-Atfad2b amiRNA Star Sequence (SEQ ID NO: 84). The amiRNA precursor 396b-Atfad3b/159-Atfad2b/159-Atfae1a (SEQ ID NO: 168) is also substantially similar to the deoxyribonucleotide sequence set forth in SEQ ID NO: 152 (from nt 1571 to 2529 of 396b-Atfad3b/159-Atfad2b/159-Atfae1a) wherein nucleotides 276 to 296 of SEQ ID NO: 152 are replaced by 159-Atfae1a amiRNA (SEQ ID NO: 95) and wherein nucleotides 121 to 141 of SEQ ID NO: 152 are replaced by 159-faea amiRNA Star Sequence (SEQ ID NO: 96).

In addition to the double amiRNA precursors targeting fad2 and fad3 and the triple amiRNA precursors targeting fad2, fad3 and fae1, constructs were made where a double amiRNA precursor targeting fad2 and fad3 was placed downstream of the beta-conglycinin promoter and a second amiRNA precursor targeting fae1 was placed in a separate cassette downstream of the soy glycinin Gy1 promoter (Chen, Z-L, et al., EMBO J. 7:297-302 (1988)),).

The amiRNA combinations made and the corresponding vector sequences are described in Table 38.

TABLE 38

Precursor amiRNA combinations and amiRNA Expression Vectors For *Arabidopsis* and/or *Brassica* Fatty Acid Biosynthetic Gene Sequences Targeted for Silencing

| amiRNA Precursor 1 (beta-conglycinin promoter) | amiRNA Precursor 1 SEQ ID NO | amiRNA Precursor 2 (glycinin Gy1 promoter) | amiRNA Precursor 2 SEQ ID NO | Plasmid Name | Plasmid SEQ ID NO |
|---|---|---|---|---|---|
| 159-Atfad2a/396b-Atfad3b amiRNA | 154 | 159-faeIa amiRNA | 146 | pKR2333 | 170 |
| 159-Atfad2b/396b-Atfad3b amiRNA | 156 | 159-faeIa amiRNA | 146 | pKR2334 | 171 |
| 396b-Atfad3b/159-Atfad2a amiRNA | 158 | 159-faeIa amiRNA | 146 | pKR2335 | 172 |
| 396b-Atfad3b/159-Atfad2b amiRNA | 160 | 159-faeIa amiRNA | 146 | pKR2336 | 173 |

Example 9

Phenotypic Analysis of *Arabidopsis* Seed Expressing amiRNA Combinations for Silencing *Arabidopsis* and/or *Brassica* Fatty Acid Biosynthetic Genes Transformation of *Arabidopsis* Plants Plasmids listed in Table 37 or 38 (Example 8) were introduced into *Agrobacterium tumefaciens* NTL4 (Luo et al, *Molecular Plant-Microbe Interactions* (2001) 14(1):98-103) and *Arabidopsis* plants were repeatedly dipped into the respective *Agrobacterium* suspensions exactly as described herein. Plants were maintained, T1 seeds were harvested and transformants selected for each experiment also exactly as described herein.

Further, all T2 and T3 seed from events selected were harvested and analyzed exactly as herein.

Fatty Acid Analysis of Bulk T2 Seed

Fatty acid profiles for approximately 10-20 events for each experiment (plants transformed with constructs listed in Table 37) are presented in Tables 39 to 41 below. In each Table, fatty acids are identified as 16:0 (palmitate), 18:0 (stearic acid), 18:1 (oleic acid), 18:2 (linoleic acid) and 18:3 (alpha-linolenic acid), 20:0 (eicosanoic acid), 20:1 eicosenoic acid) 20:2 (eicocadienoic acid) and 20:3 (eicosatrienoic acid) and results are expressed as a weight percent (wt. %) of total fatty acids. Fatty acid profiles are sorted from highest 18:1 to lowest. A wild-type Columbia seed batch was also run and shown for comparison in each Table as col-0.

TABLE 39

Fatty acid profiles of lipid from bulk T2 seed samples for events transformed with pKR2232, pKR2233, pKR2234 or pKR2235 expressing the double amiRNAs targeting fad2 and fad3

| Event | 16:0 | 18:0 | 18:1 | 18:2 | 18:3 | 20:0 | 20:1 | 20:2 |
|---|---|---|---|---|---|---|---|---|
| Col-0 | 10.2 | 2.7 | 14.0 | 32.4 | 21.6 | 1.3 | 15.8 | 1.9 |
| pKR2232-1 | 6.9 | 2.6 | 55.9 | 10.5 | 3.1 | 1.0 | 19.7 | 0.2 |
| pKR2232-6 | 6.7 | 2.6 | 54.7 | 10.7 | 2.7 | 1.2 | 21.2 | 0.2 |
| pKR2232-2 | 6.4 | 2.5 | 53.9 | 11.3 | 3.8 | 1.1 | 20.8 | 0.3 |

TABLE 39-continued

Fatty acid profiles of lipid from bulk T2 seed samples for events transformed with pKR2232, pKR2233, pKR2234 or pKR2235 expressing the double amiRNAs targeting fad2 and fad3

| Event | 16:0 | 18:0 | 18:1 | 18:2 | 18:3 | 20:0 | 20:1 | 20:2 |
|---|---|---|---|---|---|---|---|---|
| pKR2232-3 | 6.5 | 2.6 | 53.4 | 11.3 | 4.4 | 1.0 | 20.5 | 0.3 |
| pKR2232-8 | 6.3 | 2.2 | 53.3 | 12.3 | 4.6 | 1.0 | 20.1 | 0.3 |
| pKR2232-4 | 7.2 | 2.6 | 49.9 | 13.1 | 4.9 | 1.2 | 20.8 | 0.4 |
| pKR2232-5 | 6.9 | 2.5 | 49.1 | 14.5 | 5.1 | 1.1 | 20.4 | 0.5 |
| pKR2232-7 | 7.3 | 2.6 | 40.5 | 19.1 | 8.9 | 1.2 | 19.6 | 0.8 |
| pKR2233-5 | 6.4 | 2.4 | 60.1 | 7.2 | 2.0 | 1.0 | 20.6 | 0.1 |
| pKR2233-3 | 7.0 | 2.7 | 58.1 | 8.7 | 2.4 | 1.0 | 20.0 | 0.1 |
| pKR2233-1 | 6.1 | 2.7 | 58.1 | 8.1 | 2.0 | 1.2 | 21.6 | 0.2 |
| pKR2233-9 | 7.4 | 2.7 | 54.8 | 10.6 | 3.0 | 1.1 | 20.2 | 0.2 |
| pKR2233-8 | 6.5 | 2.2 | 54.2 | 10.4 | 4.5 | 1.0 | 20.9 | 0.3 |
| pKR2233-10 | 6.6 | 2.5 | 53.2 | 11.1 | 4.6 | 1.1 | 20.5 | 0.4 |
| pKR2233-2 | 6.4 | 2.8 | 52.3 | 11.0 | 4.6 | 1.3 | 21.2 | 0.4 |
| pKR2233-11 | 7.1 | 2.7 | 49.2 | 14.0 | 4.1 | 1.2 | 21.3 | 0.4 |
| pKR2233-6 | 6.8 | 2.7 | 46.8 | 15.6 | 6.5 | 1.2 | 19.8 | 0.6 |
| pKR2233-7 | 7.3 | 2.9 | 45.5 | 16.2 | 7.2 | 1.1 | 19.2 | 0.6 |
| pKR2233-4 | 7.2 | 2.4 | 43.0 | 17.8 | 7.1 | 1.2 | 20.6 | 0.7 |
| pKR2234-1 | 5.8 | 2.5 | 52.5 | 13.4 | 1.4 | 1.2 | 22.9 | 0.3 |
| pKR2234-9 | 6.8 | 2.8 | 49.5 | 17.3 | 1.7 | 1.2 | 20.4 | 0.3 |
| pKR2234-5 | 7.1 | 2.6 | 47.4 | 18.5 | 2.4 | 1.2 | 20.4 | 0.4 |
| pKR2234-10 | 7.2 | 2.9 | 47.3 | 17.5 | 2.7 | 1.2 | 20.7 | 0.4 |
| pKR2234-13 | 7.3 | 2.6 | 45.2 | 20.5 | 1.9 | 1.2 | 21.0 | 0.5 |
| pKR2234-6 | 7.4 | 3.0 | 43.7 | 19.4 | 5.0 | 1.2 | 19.7 | 0.6 |
| pKR2234-11 | 7.3 | 2.8 | 40.6 | 21.2 | 5.3 | 1.3 | 20.8 | 0.7 |
| pKR2234-4 | 7.6 | 2.8 | 37.9 | 24.3 | 6.1 | 1.2 | 19.3 | 0.7 |
| pKR2234-7 | 7.7 | 2.7 | 37.3 | 24.4 | 6.2 | 1.3 | 19.5 | 0.8 |
| pKR2234-8 | 7.5 | 2.8 | 36.8 | 24.9 | 5.9 | 1.3 | 19.9 | 0.8 |
| pKR2234-3 | 8.1 | 2.7 | 33.9 | 28.5 | 5.5 | 1.3 | 19.1 | 0.9 |
| pKR2234-12 | 8.5 | 2.7 | 28.4 | 31.0 | 7.3 | 1.2 | 19.8 | 1.1 |
| pKR2234-2 | 8.6 | 2.8 | 22.3 | 34.9 | 8.4 | 1.5 | 20.2 | 1.3 |
| pKR2234-14 | 8.0 | 2.9 | 18.1 | 41.9 | 6.6 | 1.6 | 18.9 | 2.1 |
| pKR2235-6 | 6.3 | 2.6 | 53.0 | 12.9 | 1.7 | 1.2 | 22.1 | 0.3 |
| pKR2235-10 | 6.7 | 2.7 | 52.0 | 15.6 | 2.5 | 1.0 | 19.2 | 0.3 |
| pKR2235-5 | 6.1 | 2.7 | 52.1 | 12.9 | 1.6 | 1.3 | 22.9 | 0.3 |
| pKR2235-4 | 6.2 | 2.6 | 48.0 | 16.2 | 2.5 | 1.3 | 22.8 | 0.4 |
| pKR2235-8 | 8.2 | 2.8 | 45.6 | 20.5 | 3.0 | 1.1 | 18.3 | 0.4 |
| pKR2235-12 | 7.6 | 2.8 | 45.4 | 19.1 | 4.2 | 1.1 | 19.3 | 0.5 |
| pKR2235-7 | 6.3 | 3.0 | 45.5 | 16.8 | 4.0 | 1.5 | 22.4 | 0.6 |
| pKR2235-9 | 7.3 | 2.5 | 45.0 | 19.3 | 5.0 | 1.0 | 19.4 | 0.5 |
| pKR2235-11 | 7.4 | 2.7 | 44.5 | 19.6 | 5.0 | 1.1 | 19.1 | 0.5 |
| pKR2235-13 | 7.5 | 2.8 | 44.2 | 20.9 | 3.6 | 1.2 | 19.2 | 0.6 |
| pKR2235-15 | 7.2 | 2.8 | 42.9 | 18.8 | 6.6 | 1.2 | 19.8 | 0.7 |
| pKR2235-1 | 6.7 | 2.9 | 41.3 | 19.8 | 6.0 | 1.4 | 21.0 | 0.7 |
| pKR2235-16 | 7.7 | 2.7 | 38.6 | 21.5 | 7.2 | 1.2 | 20.3 | 0.8 |
| pKR2235-14 | 7.9 | 2.9 | 37.4 | 22.7 | 8.8 | 1.2 | 18.4 | 0.8 |
| pKR2235-2 | 7.6 | 2.8 | 36.4 | 24.9 | 6.4 | 1.4 | 19.8 | 0.8 |
| pKR2235-3 | 7.9 | 2.8 | 20.0 | 31.1 | 16.8 | 1.5 | 18.4 | 1.6 |

From Table 39, events expressing double fad2/fad3 amiRNAs function to suppress both fad2 and fad3 and increase 18:1 content to as high as 60.1%, in bulk T2 seed, compared to 14.0% for the wild-type seed, with a decrease in 18:3 content to as low as 2.0%, compared to 21.6% for the wild-type seed. Further, the increase in 18:1 was higher than in events expressing a fad2 only amiRNA where the highest 18:1 obtained was 57.5% (Table 19) in T2 seed. Also, the decrease in 18:3 was more pronounced than observed in the best fad2 amiRNA-only event, where the lowest 18:3 obtained was 5.9% (Table 19) and is comparable to the best fad3 amiRNA-only amiRNA event where the lowest 18:3 obtained was 1.5% Table 25).

It is interesting to note that in the event having 60.1% 18:1 and 2% 18:3 (Table 39), the 20:1 content is increased to 20.6% from 15.8% observed in the wt seed.

TABLE 40

Fatty acid profiles of lipid from bulk T2 seed samples for events transformed with pKR2248, pKR2249, pKR2250 or pKR2251 expressing the triple amiRNAs targeting fad2, fad3 and fae1.

| Event | 16:0 | 18:0 | 18:1 | 18:2 | 18:3 | 20:0 | 20:1 | 20:2 |
|---|---|---|---|---|---|---|---|---|
| Col-0 | 10.2 | 2.7 | 14.0 | 32.4 | 21.6 | 1.3 | 15.8 | 1.9 |
| pKR2248-17 | 6.8 | 2.2 | 71.7 | 10.7 | 3.5 | 0.6 | 4.3 | 0.2 |
| pKR2248-6 | 8.1 | 2.7 | 68.6 | 12.3 | 3.5 | 0.6 | 4.1 | 0.1 |
| pKR2248-18 | 8.0 | 2.7 | 66.8 | 12.8 | 4.2 | 0.6 | 4.7 | 0.2 |
| pKR2248-15 | 7.5 | 2.5 | 65.4 | 14.1 | 4.0 | 0.7 | 5.5 | 0.3 |
| pKR2248-4 | 8.2 | 2.8 | 64.4 | 13.0 | 4.8 | 0.8 | 5.6 | 0.4 |
| pKR2248-12 | 8.1 | 2.6 | 58.7 | 16.4 | 6.0 | 0.7 | 6.9 | 0.5 |
| pKR2248-11 | 7.7 | 2.4 | 58.2 | 16.3 | 6.7 | 0.8 | 7.4 | 0.5 |
| pKR2248-1 | 7.4 | 2.5 | 58.0 | 15.8 | 6.6 | 0.8 | 8.3 | 0.5 |
| pKR2248-3 | 7.4 | 2.7 | 57.6 | 15.6 | 7.1 | 0.9 | 8.1 | 0.6 |
| pKR2248-2 | 8.3 | 2.7 | 56.6 | 17.7 | 6.1 | 0.7 | 7.4 | 0.4 |
| pKR2248-13 | 7.7 | 2.5 | 56.3 | 17.2 | 6.9 | 0.9 | 8.1 | 0.5 |
| pKR2248-7 | 7.4 | 2.7 | 55.7 | 16.6 | 7.5 | 0.9 | 8.7 | 0.6 |
| pKR2248-14 | 7.9 | 2.6 | 54.9 | 17.0 | 8.3 | 0.9 | 7.8 | 0.6 |
| pKR2248-8 | 7.9 | 2.9 | 53.3 | 18.1 | 7.2 | 0.9 | 9.2 | 0.6 |
| pKR2248-9 | 7.4 | 2.6 | 51.9 | 18.3 | 8.3 | 1.1 | 9.7 | 0.8 |
| pKR2248-10 | 7.6 | 3.0 | 48.4 | 20.4 | 7.9 | 1.1 | 10.8 | 0.7 |
| pKR2248-16 | 9.1 | 2.6 | 46.1 | 22.4 | 8.9 | 1.0 | 9.1 | 0.7 |
| pKR2248-5 | 8.4 | 2.5 | 46.2 | 22.4 | 8.6 | 1.0 | 10.3 | 0.7 |
| pKR2249-10 | 7.3 | 2.5 | 67.3 | 16.0 | 1.6 | 0.7 | 4.4 | 0.1 |
| pKR2249-6 | 8.3 | 2.8 | 64.0 | 17.7 | 3.0 | 0.6 | 3.3 | 0.2 |
| pKR2249-12 | 6.8 | 2.8 | 63.5 | 16.1 | 3.0 | 0.9 | 6.6 | 0.3 |
| pKR2249-2 | 8.4 | 3.0 | 59.4 | 19.8 | 2.3 | 0.7 | 6.2 | 0.2 |
| pKR2249-1 | 8.0 | 2.6 | 56.2 | 20.1 | 5.1 | 0.7 | 6.8 | 0.4 |
| pKR2249-4 | 7.9 | 2.8 | 55.5 | 19.8 | 5.6 | 0.8 | 7.2 | 0.5 |
| pKR2249-7 | 7.9 | 2.7 | 52.0 | 22.0 | 5.5 | 0.8 | 8.5 | 0.6 |
| pKR2249-3 | 7.9 | 2.7 | 47.8 | 24.6 | 6.0 | 0.9 | 9.6 | 0.6 |
| pKR2249-11 | 7.1 | 2.9 | 45.4 | 24.4 | 6.0 | 1.1 | 12.4 | 0.7 |
| pKR2249-8 | 9.2 | 2.6 | 43.7 | 28.1 | 6.5 | 0.8 | 8.5 | 0.6 |
| pKR2249-9 | 9.2 | 2.5 | 42.9 | 31.8 | 4.0 | 0.7 | 8.6 | 0.5 |
| pKR2249-16 | 8.7 | 3.0 | 42.4 | 29.8 | 4.1 | 0.7 | 10.8 | 0.6 |
| pKR2249-5 | 8.2 | 2.7 | 39.4 | 30.5 | 5.7 | 0.9 | 11.9 | 0.7 |
| pKR2249-14 | 9.2 | 3.0 | 32.3 | 29.3 | 11.7 | 1.1 | 12.4 | 1.1 |
| pKR2249-15 | 8.6 | 2.6 | 28.3 | 36.2 | 7.3 | 1.1 | 14.7 | 1.1 |
| pKR2249-13 | 8.0 | 2.9 | 16.9 | 29.9 | 18.4 | 1.8 | 20.1 | 2.0 |
| pKR2250-1 | 6.8 | 2.6 | 72.2 | 9.8 | 2.9 | 0.7 | 4.8 | 0.1 |
| pKR2250-11 | 7.0 | 2.7 | 71.6 | 9.7 | 3.4 | 0.7 | 4.6 | 0.2 |
| pKR2250-12 | 7.1 | 2.9 | 70.9 | 10.0 | 3.4 | 0.8 | 4.8 | 0.2 |
| pKR2250-15 | 7.3 | 2.8 | 69.7 | 10.5 | 3.3 | 0.8 | 5.2 | 0.2 |
| pKR2250-16 | 7.1 | 3.0 | 69.0 | 11.6 | 3.2 | 0.9 | 5.1 | 0.2 |
| pKR2250-2 | 7.8 | 2.7 | 66.0 | 13.5 | 3.8 | 0.8 | 5.1 | 0.2 |
| pKR2250-4 | 7.7 | 3.1 | 63.1 | 12.9 | 5.4 | 0.9 | 6.5 | 0.4 |
| pKR2250-8 | 7.9 | 2.8 | 62.2 | 14.3 | 6.2 | 0.6 | 5.6 | 0.4 |
| pKR2250-9 | 7.2 | 2.7 | 60.7 | 14.5 | 5.6 | 0.9 | 7.9 | 0.5 |
| pKR2250-14 | 7.4 | 3.0 | 60.5 | 14.0 | 6.1 | 1.0 | 7.4 | 0.5 |
| pKR2250-7 | 7.0 | 3.0 | 60.0 | 14.4 | 5.9 | 1.0 | 8.3 | 0.5 |
| pKR2250-3 | 7.0 | 2.6 | 59.7 | 14.7 | 6.1 | 1.0 | 8.2 | 0.6 |
| pKR2250-5 | 7.5 | 2.6 | 57.1 | 16.8 | 6.3 | 1.0 | 8.2 | 0.6 |
| pKR2250-10 | 9.3 | 2.7 | 51.9 | 19.7 | 7.9 | 0.7 | 7.3 | 0.5 |
| pKR2250-13 | 6.9 | 2.8 | 50.7 | 18.2 | 8.4 | 1.0 | 11.1 | 0.8 |
| pKR2250-6 | 8.2 | 2.7 | 48.7 | 20.1 | 8.0 | 1.1 | 10.4 | 0.7 |
| pKR2251-3 | 6.9 | 2.2 | 71.9 | 12.2 | 2.2 | 0.6 | 3.8 | 0.1 |
| pKR2251-1 | 7.0 | 2.6 | 67.3 | 14.5 | 2.4 | 0.7 | 5.2 | 0.2 |
| pKR2251-11 | 6.6 | 2.6 | 67.3 | 13.6 | 2.7 | 0.7 | 6.3 | 0.2 |
| pKR2251-4 | 7.5 | 2.7 | 66.8 | 14.1 | 2.4 | 0.6 | 5.6 | 0.2 |
| pKR2251-12 | 7.7 | 3.2 | 62.8 | 16.0 | 2.3 | 0.8 | 7.1 | 0.2 |
| pKR2251-5 | 7.0 | 2.4 | 59.4 | 18.0 | 3.8 | 0.7 | 8.4 | 0.4 |
| pKR2251-9 | 7.3 | 2.7 | 57.3 | 17.6 | 5.3 | 0.9 | 8.4 | 0.5 |
| pKR2251-17 | 7.8 | 2.7 | 55.8 | 18.6 | 5.3 | 0.8 | 8.5 | 0.5 |
| pKR2251-14 | 7.3 | 2.7 | 55.5 | 19.1 | 4.7 | 0.9 | 9.3 | 0.5 |
| pKR2251-10 | 7.9 | 3.0 | 54.4 | 18.6 | 6.3 | 0.9 | 8.5 | 0.6 |
| pKR2251-18 | 7.8 | 3.2 | 53.7 | 19.8 | 4.4 | 0.9 | 9.8 | 0.5 |
| pKR2251-13 | 7.5 | 2.6 | 52.0 | 20.2 | 6.0 | 0.9 | 10.2 | 0.6 |
| pKR2251-15 | 7.2 | 2.9 | 51.1 | 21.3 | 4.9 | 1.0 | 11.1 | 0.5 |
| pKR2251-8 | 7.8 | 2.9 | 49.8 | 20.7 | 7.0 | 1.1 | 10.0 | 0.7 |
| pKR2251-16 | 7.8 | 2.9 | 49.1 | 20.5 | 7.6 | 1.1 | 10.2 | 0.7 |
| pKR2251-7 | 7.2 | 2.9 | 47.1 | 22.8 | 6.5 | 1.0 | 11.9 | 0.7 |
| pKR2251-2 | 8.1 | 2.8 | 45.1 | 24.2 | 6.8 | 0.8 | 11.4 | 0.7 |
| pKR2251-6 | 7.7 | 3.0 | 38.9 | 27.9 | 6.2 | 1.1 | 14.4 | 0.8 |

From Table 40, events expressing triple fad2/fad3/faeI amiRNAs function to suppress fad2, fad3 and faeI and increase 18:1 content to as high as 72%, in bulk T2 seed, compared to 14.0% for the wild-type seed, with a decrease in 18:3 content to as low as 2%, compared to 21.6% for the wild-type seed and decrease in 20:1 to as low as 4% compared to 15.8% in wild-type seed. Further, the increase in 18:1 was higher than in events expressing a fad2/fad3 double amiRNA where the highest 18:1 obtained was 60.1% in T2 seed. Also, the decrease in 18:3 was similar to the lowest 18:3 in either the fad3 amiRNA-only or fad2/fad3 double amiRNA events (1.5%-2%). In addition, the decrease in 20:1 to 4% is lower than significantly lower than that observed in the best double fad2/fad3 double amiRNA event (where 20:1 had actually increased to 20.6%.

TABLE 41

Fatty acid profiles of lipid from bulk T2 seed samples for events transformed with pKR2333, pKR2334, pKR2335 or pKR2336 expressing one double amiRNAs targeting fad2 and fad3 and another amiRNA targeting faeI.

| Event | 16:0 | 18:0 | 18:1 | 18:2 | 18:3 | 20:0 | 20:1 | 20:2 |
|---|---|---|---|---|---|---|---|---|
| Col-0 | 10.2 | 2.7 | 14.0 | 32.4 | 21.6 | 1.3 | 15.8 | 1.9 |
| pKR2333-1 | 8.1 | 3.0 | 68.3 | 12.5 | 4.4 | 0.6 | 3.0 | 0.0 |
| pKR2333-13 | 9.9 | 4.6 | 57.7 | 14.7 | 5.9 | 0.9 | 5.7 | 0.6 |
| pKR2333-11 | 9.1 | 4.2 | 57.6 | 15.2 | 6.2 | 0.9 | 6.7 | 0.0 |
| pKR2333-18 | 8.5 | 3.6 | 16.9 | 31.4 | 18.0 | 1.8 | 17.7 | 2.0 |
| pKR2333-12 | 9.2 | 3.7 | 16.8 | 32.0 | 18.3 | 1.6 | 16.5 | 1.9 |
| pKR2333-7 | 8.3 | 3.4 | 16.5 | 32.4 | 18.2 | 1.8 | 17.5 | 1.9 |
| pKR2333-5 | 9.7 | 4.4 | 16.3 | 31.7 | 17.5 | 1.7 | 16.9 | 1.9 |
| pKR2333-2 | 9.0 | 3.2 | 16.4 | 32.3 | 19.0 | 1.6 | 16.6 | 1.9 |
| pKR2333-16 | 8.4 | 3.5 | 16.2 | 31.3 | 19.2 | 1.9 | 17.4 | 2.1 |
| pKR2333-6 | 9.0 | 3.7 | 16.2 | 31.6 | 18.5 | 1.6 | 17.5 | 2.0 |
| pKR2333-15 | 9.0 | 3.6 | 16.1 | 32.0 | 18.2 | 1.6 | 17.6 | 1.9 |
| pKR2333-8 | 9.6 | 3.9 | 16.0 | 32.5 | 18.6 | 1.7 | 15.9 | 1.9 |
| pKR2333-3 | 8.7 | 3.3 | 16.0 | 33.1 | 18.7 | 1.7 | 16.7 | 1.9 |
| pKR2333-14 | 9.1 | 3.3 | 16.0 | 32.0 | 19.2 | 1.4 | 16.9 | 2.0 |
| pKR2333-4 | 8.8 | 3.2 | 15.9 | 32.6 | 19.1 | 1.6 | 16.9 | 1.9 |
| pKR2333-10 | 9.5 | 3.9 | 15.9 | 32.0 | 18.7 | 1.7 | 16.2 | 2.0 |
| pKR2333-17 | 9.5 | 4.4 | 15.2 | 31.4 | 18.0 | 2.0 | 17.5 | 2.1 |
| pKR2333-9 | 9.6 | 4.0 | 14.5 | 32.3 | 19.2 | 2.0 | 16.5 | 1.9 |
| pKR2334-13 | 8.9 | 3.9 | 52.0 | 16.6 | 7.6 | 1.1 | 9.1 | 0.8 |
| pKR2334-9 | 0.0 | 0.0 | 44.2 | 55.8 | 0.0 | 0.0 | 0.0 | 0.0 |
| pKR2334-14 | 8.3 | 3.3 | 17.9 | 31.2 | 17.4 | 1.7 | 18.2 | 2.0 |
| pKR2334-10 | 7.9 | 3.6 | 17.9 | 30.9 | 16.1 | 2.1 | 19.5 | 1.9 |
| pKR2334-15 | 8.1 | 3.7 | 17.1 | 31.2 | 17.2 | 2.0 | 19.0 | 1.8 |
| pKR2334-4 | 8.3 | 3.0 | 16.4 | 32.2 | 18.9 | 1.6 | 17.7 | 1.9 |
| pKR2334-6 | 8.7 | 3.6 | 16.4 | 31.8 | 18.6 | 1.8 | 17.2 | 2.0 |
| pKR2334-3 | 8.9 | 3.9 | 16.2 | 32.2 | 17.7 | 1.8 | 17.4 | 1.9 |
| pKR2334-12 | 8.6 | 3.8 | 16.3 | 31.0 | 18.0 | 2.1 | 18.2 | 2.0 |
| pKR2334-16 | 8.5 | 3.4 | 16.0 | 31.5 | 18.7 | 1.7 | 18.2 | 2.0 |
| pKR2334-18 | 8.5 | 3.5 | 16.1 | 31.1 | 18.7 | 1.8 | 18.4 | 2.0 |
| pKR2334-8 | 9.2 | 3.7 | 15.9 | 31.9 | 18.6 | 1.6 | 17.1 | 1.9 |
| pKR2334-1 | 9.0 | 3.6 | 15.8 | 32.8 | 18.4 | 1.9 | 16.5 | 1.9 |
| pKR2334-11 | 8.6 | 3.8 | 15.7 | 31.6 | 17.9 | 2.0 | 18.5 | 1.9 |
| pKR2334-17 | 9.3 | 4.0 | 15.5 | 31.8 | 17.3 | 1.8 | 18.4 | 1.9 |
| pKR2334-7 | 9.6 | 4.4 | 15.2 | 31.0 | 18.2 | 2.0 | 17.7 | 1.9 |
| pKR2334-2 | 8.7 | 3.3 | 15.1 | 32.4 | 18.8 | 1.7 | 18.1 | 2.0 |
| pKR2334-5 | 9.1 | 3.5 | 15.0 | 32.9 | 18.8 | 1.7 | 16.9 | 1.9 |
| pKR2335-6 | 8.4 | 3.0 | 64.8 | 19.1 | 2.1 | 0.6 | 1.9 | 0.0 |
| pKR2335-9 | 8.7 | 3.6 | 59.6 | 22.3 | 1.7 | 0.7 | 3.2 | 0.2 |
| pKR2335-2 | 8.9 | 3.1 | 50.9 | 23.1 | 6.1 | 0.9 | 6.3 | 0.6 |
| pKR2335-12 | 8.7 | 3.5 | 50.7 | 23.0 | 5.6 | 0.9 | 7.0 | 0.6 |
| pKR2335-13 | 8.5 | 3.4 | 50.8 | 22.8 | 5.8 | 0.9 | 7.2 | 0.6 |
| pKR2335-15 | 8.6 | 3.5 | 48.0 | 25.2 | 6.1 | 1.0 | 7.1 | 0.7 |
| pKR2335-5 | 9.3 | 3.6 | 47.9 | 23.9 | 6.5 | 0.9 | 7.3 | 0.7 |
| pKR2335-7 | 8.8 | 3.2 | 47.2 | 26.2 | 5.8 | 0.9 | 7.3 | 0.6 |
| pKR2335-1 | 9.5 | 4.0 | 47.0 | 23.3 | 6.8 | 1.0 | 7.5 | 0.8 |
| pKR2335-10 | 8.4 | 3.6 | 45.9 | 26.0 | 6.7 | 1.1 | 7.7 | 0.7 |
| pKR2335-3 | 9.5 | 3.7 | 45.1 | 29.9 | 4.6 | 0.7 | 5.9 | 0.6 |
| pKR2335-4 | 8.6 | 3.3 | 44.9 | 29.8 | 5.5 | 0.8 | 6.4 | 0.6 |
| pKR2335-14 | 8.5 | 3.5 | 44.9 | 26.0 | 6.9 | 1.1 | 8.4 | 0.8 |
| pKR2335-16 | 8.7 | 3.5 | 44.8 | 25.3 | 6.8 | 1.0 | 8.9 | 0.8 |
| pKR2335-17 | 9.3 | 4.4 | 43.7 | 26.2 | 6.4 | 1.1 | 8.2 | 0.7 |
| pKR2335-8 | 8.3 | 3.4 | 43.7 | 23.4 | 9.5 | 1.1 | 9.6 | 1.0 |

TABLE 41-continued

Fatty acid profiles of lipid from bulk T2 seed samples for events transformed with pKR2333, pKR2334, pKR2335 or pKR2336 expressing one double amiRNAs targeting fad2 and fad3 and another amiRNA targeting faeI.

| Event | 16:0 | 18:0 | 18:1 | 18:2 | 18:3 | 20:0 | 20:1 | 20:2 |
|---|---|---|---|---|---|---|---|---|
| pKR2335-11 | 8.3 | 3.4 | 43.5 | 28.2 | 6.7 | 0.9 | 8.2 | 0.7 |
| pKR2336-16 | 7.5 | 3.1 | 64.9 | 17.8 | 2.6 | 0.7 | 3.2 | 0.2 |
| pKR2336-6 | 7.7 | 2.9 | 63.7 | 18.6 | 2.7 | 0.6 | 3.8 | 0.0 |
| pKR2336-11 | 7.7 | 3.1 | 62.6 | 18.7 | 3.3 | 0.7 | 3.6 | 0.2 |
| pKR2336-8 | 7.0 | 3.0 | 60.8 | 15.7 | 3.1 | 0.8 | 9.2 | 0.4 |
| pKR2336-9 | 8.5 | 3.2 | 58.0 | 22.1 | 2.1 | 0.7 | 5.1 | 0.2 |
| pKR2336-14 | 8.0 | 3.5 | 54.8 | 20.2 | 5.7 | 1.0 | 6.4 | 0.5 |
| pKR2336-3 | 7.8 | 2.8 | 52.2 | 25.1 | 5.3 | 0.8 | 5.6 | 0.5 |
| pKR2336-2 | 8.6 | 3.2 | 46.2 | 23.0 | 8.8 | 1.1 | 8.3 | 0.8 |
| pKR2336-17 | 8.0 | 3.2 | 19.0 | 32.0 | 17.0 | 1.7 | 17.4 | 1.7 |
| pKR2336-13 | 8.1 | 3.2 | 18.0 | 32.3 | 17.0 | 1.8 | 17.8 | 1.7 |
| pKR2336-5 | 8.4 | 3.2 | 16.3 | 32.9 | 18.3 | 1.7 | 17.4 | 1.8 |
| pKR2336-15 | 8.3 | 3.3 | 16.3 | 32.3 | 18.1 | 1.9 | 18.0 | 1.8 |
| pKR2336-12 | 8.2 | 3.2 | 16.2 | 32.4 | 18.1 | 1.8 | 18.2 | 1.8 |
| pKR2336-7 | 8.5 | 3.2 | 15.6 | 32.7 | 18.5 | 1.8 | 17.7 | 1.9 |
| pKR2336-4 | 9.0 | 3.3 | 15.2 | 33.0 | 18.6 | 1.9 | 17.0 | 1.9 |
| pKR2336-1 | 9.3 | 3.0 | 15.1 | 34.4 | 18.4 | 1.7 | 16.3 | 1.8 |
| pKR2336-10 | 8.6 | 3.4 | 15.2 | 32.4 | 18.7 | 2.1 | 17.6 | 1.9 |

From Table 41, events expressing double fad2/fad3 and single faeI amiRNAs together function to suppress fad2, fad3 and fae1 and increase 18:1 content to as high as 68%, in bulk T2 seed, compared to 14.0% for the wild-type seed, with a decrease in 18:3 content to as low as 4%, compared to 21.6% for the wild-type seed and decrease in 20:1 to as low as 3% compared to 15.8% in wild-type seed. Other events had 18:1 at 65% with 18:3 at 2% and 20:1 also at 2%. As described for the triple amiRNA construct shown in Table 40, these fatty acid profiles are better than for the double amiRNA constructs alone.

Fatty Acid Analysis of Bulk T3 Seed from Homozygous Plants

All T2 events for all constructs were plated on Kanamycin as described above and those events where kanamycin resistant T2 plants segregated from kanamycin sensitive plants by a ratio of 3:1, indicating a single copy insertion and showing 3:1 segregation of single T2 seed phenotype (as described herein) were were advanced to obtain homozygous T3 seed exactly as described herein. The fatty acid profile for T3 seed from homozygous T2 plants was also determined exactly as described herein.

Results for fatty acid profiles for homozygous T3 seed batches for one representative event from each experiment are presented in Tables 42 to 44 below. In each Table, fatty acids are identified as 16:0 (palmitate), 18:0 (stearic acid), 18:1 (oleic acid), 18:2 (linoleic acid) and 18:3 (alpha-linolenic acid), 20:0 (eicosanoic acid), 20:1 eicosenoic acid) 20:2 (eicocadienoic acid) and 20:3 (eicosatrienoic acid) and results are expressed as a weight percent (wt. %) of total fatty acids. Fatty acid profiles are sorted from highest 18:1 to lowest. A wild-type Columbia seed batch was also run and shown for comparison in each Table as col-0.

TABLE 42

Fatty acid profiles of lipid from bulk T3 seed samples for events transformed with pKR2232, pKR2233, pKR2234 or pKR2235 expressing the double amiRNAs targeting fad2 and fad3

| Event | 16:0 | 18:0 | 18:1 | 18:2 | 18:3 | 20:0 | 20:1 | 20:2 |
|---|---|---|---|---|---|---|---|---|
| pKR2232-3-9 | 7.2 | 3.2 | 55.4 | 10.8 | 2.3 | 1.3 | 19.9 | 0.0 |
| pKR2232-3-17 | 7.0 | 3.0 | 51.4 | 13.7 | 3.1 | 1.2 | 20.2 | 0.3 |
| pKR2233-10-1 | 9.3 | 2.8 | 64.7 | 9.9 | 2.8 | 0.0 | 10.5 | 0.0 |
| pKR2233-10-11 | 7.8 | 3.0 | 59.1 | 9.2 | 2.3 | 1.0 | 17.6 | 0.0 |
| pKR2233-10-9 | 8.3 | 2.8 | 58.8 | 10.2 | 2.8 | 1.0 | 16.2 | 0.0 |
| pKR2234-4-13 | 7.6 | 3.2 | 45.5 | 21.1 | 1.7 | 1.4 | 19.5 | 0.0 |
| pKR2234-4-2 | 7.8 | 3.0 | 45.4 | 22.1 | 1.7 | 1.2 | 18.9 | 0.0 |
| pKR2234-4-5 | 7.5 | 3.2 | 44.3 | 21.6 | 2.3 | 1.4 | 19.7 | 0.0 |
| pKR2235-5-9 | 7.2 | 3.0 | 53.6 | 13.7 | 1.8 | 1.2 | 19.3 | 0.3 |
| pKR2235-5-3 | 7.2 | 2.9 | 52.4 | 14.2 | 1.8 | 1.2 | 20.0 | 0.3 |
| pKR2235-5-7 | 7.0 | 2.9 | 51.4 | 14.7 | 1.8 | 1.2 | 20.7 | 0.3 |

From Table 42, events expressing double fad2/fad3 amiRNAs function to suppress both fad2 and fad3 and increase 18:1 content to as high as 65%, in bulk T3 seed, compared to 14.0% for the wild-type seed, with a decrease in 18:3 content to 3%, compared to 21.6% for the wild-type seed.

TABLE 43

Fatty acid profiles of lipid from bulk T3 seed samples for events transformed with pKR2248, pKR2249, pKR2250 or pKR2251 expressing the triple amiRNAs targeting fad2, fad3 and faeI.

| Event | 16:0 | 18:0 | 18:1 | 18:2 | 18:3 | 20:0 | 20:1 | 20:2 |
|---|---|---|---|---|---|---|---|---|
| pKR2248-4-2 | 6.8 | 3.0 | 75.3 | 9.2 | 1.8 | 0.7 | 3.1 | 0.1 |
| pKR2248-4-11 | 7.3 | 3.5 | 70.5 | 11.1 | 2.7 | 0.8 | 3.9 | 0.2 |
| pKR2249-1-18 | 7.9 | 3.3 | 58.4 | 20.7 | 2.1 | 0.8 | 6.4 | 0.3 |
| pKR2249-1-12 | 7.9 | 3.3 | 58.2 | 21.1 | 2.1 | 0.8 | 6.2 | 0.3 |
| pKR2249-1-6 | 8.3 | 3.1 | 56.6 | 23.3 | 2.2 | 0.7 | 5.5 | 0.3 |
| pKR2250-4-6 | 7.7 | 2.9 | 74.5 | 9.2 | 2.2 | 0.6 | 2.9 | 0.0 |
| pKR2250-4-10 | 8.3 | 2.7 | 73.6 | 10.2 | 2.6 | 0.0 | 2.7 | 0.0 |
| pKR2250-4-15 | 8.5 | 2.5 | 72.5 | 10.6 | 3.1 | 0.0 | 2.7 | 0.0 |
| pKR2251-17-11 | 8.6 | 2.6 | 65.7 | 15.9 | 2.4 | 0.6 | 4.2 | 0.0 |
| pKR2251-17-16 | 8.4 | 2.6 | 65.5 | 16.0 | 2.2 | 0.5 | 4.7 | 0.0 |
| pKR2251-17-12 | 8.5 | 2.7 | 65.0 | 16.4 | 2.2 | 0.5 | 4.7 | 0.0 |

From Table 43, events expressing triple fad2/fad3/faeI amiRNAs function to suppress fad2, fad3 and faeI and increase 18:1 content to as high as 75%, in bulk T3 seed, compared to 14.0% for the wild-type seed, with a decrease in 18:3 content to 2%, compared to 21.6% for the wild-type seed and decrease in 20:1 to 3% compared to 15.8% in wild-type seed.

TABLE 44

Fatty acid profiles of lipid from bulk T3 seed samples for events transformed with pKR2333, pKR2334, pKR2335 or pKR2336 expressing one double amiRNAs targeting fad2 and fad3 and another amiRNA targeting faeI.

| Event | 16:0 | 18:0 | 18:1 | 18:2 | 18:3 | 20:0 | 20:1 | 20:2 |
|---|---|---|---|---|---|---|---|---|
| 2333-13-7 | 7.6 | 2.4 | 74.3 | 9.3 | 2.9 | 0.7 | 2.8 | 0.0 |
| 2333-13-9 | 7.6 | 2.8 | 74.1 | 10.6 | 2.3 | 0.6 | 2.0 | 0.0 |
| 2333-13-13 | 7.8 | 2.6 | 74.0 | 11.0 | 2.6 | 0.5 | 1.6 | 0.0 |
| 2334-13-22 | 8.1 | 2.3 | 73.5 | 9.9 | 3.0 | 0.5 | 2.7 | 0.0 |
| 2334-13-18 | 7.9 | 2.4 | 72.9 | 11.7 | 2.9 | 0.5 | 1.7 | 0.0 |
| 2334-13-7 | 8.2 | 2.8 | 71.1 | 10.5 | 3.0 | 0.5 | 4.0 | 0.0 |
| 2335-12-15 | 8.1 | 2.5 | 64.3 | 19.8 | 2.2 | 0.5 | 2.6 | 0.0 |
| 2335-12-7 | 8.1 | 2.4 | 64.2 | 20.1 | 2.1 | 0.5 | 2.5 | 0.0 |
| 2335-12-12 | 8.4 | 2.6 | 63.7 | 19.5 | 2.0 | 0.6 | 3.1 | 0.0 |
| 2336-3-10 | 7.2 | 2.4 | 66.7 | 19.4 | 2.1 | 0.5 | 1.7 | 0.0 |
| 2336-3-14 | 8.4 | 2.5 | 63.0 | 21.1 | 2.2 | 0.5 | 2.1 | 0.0 |
| 2336-3-1 | 8.1 | 2.8 | 62.4 | 21.3 | 2.1 | 0.5 | 2.8 | 0.0 |

From Table 44, events expressing double fad2/fad3 and single faeI amiRNAs together function to suppress fad2, fad3 and faeI and increase 18:1 content to as high as 74%, in bulk T3 seed, compared to 14.0% for the wild-type seed, with a decrease in 18:3 content to 2%, compared to 21.6% for the wild-type seed and decrease in 20:1 to 2% compared to 15.8% in wild-type seed.

SEQUENCE LISTING (175 sequences)

SEQ ID NO: 1 - DNA, 1164 bp, Glycine max
atgggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattga

SEQ ID NO: 2 - protein, 387 aa, Glycine max
MGLAKETTMGGRGRVAKVEVQGKKPLSRVPNTKPPFTVGQLKKAIPPHCFQRSLLTSFSYVVYDLSFAFIFYIATTYFHLLPQPFSLIAWPIYWVLQGCLLTGVWVIAHECGHHAFSKYQWVDDVVGLTLHSTLLVPYFSWKISHRRHHSNTGSLDRDEVFVPKPKSKVAWFSKYLNNPLGRAVSLLVTLTIGWPMYLAFNVSGRPYDSFASHYHPYAPIYSNRERLLIYVSDVALFSVTYSLYRVATLKGLVWLLCVYGVPLLIVNGFLVTITYLQHTHFALPHYDSSEWDWLKGALATMDRDYGILNKVFHHITDTHVAHHLFSTMPHYHAMEATNAIKPILGEYYQFDDTPFYKALWREARECLYVEPDEGTSEKGVYWYRNKY

SEQ ID NO: 3 - DNA, 1164 bp, Glycine max
atgggtctagcaaaggaaacaataatgggaggtggaggccgtgtggccaaagttgaaattcagcagaagaagcctctctcaagggttccaaacacaaagccaccattcactgttggccaactcaagaaagccattccaccgcactgctttcagcgttccctcctcacttcattgtcctatgttgtttatgacctttcattggctttcattttctacattgccaccacctacttccacctcctccctcaccccttttccctcattgcatggccaatctattgggttctccaaggttgcattcttactggcgtgtgggtgattgctcacgagtgtggtcaccatgccttcagcaagtacccatgggttgatgatgttatgggtttgaccgttcactcagcacttttagtcccttatttctcatggaaaataagccatcgccgccaccactccaacacgggttcccttgaccgtgatgaagtgtttgtcccaaaaccaaaatccaaagttgcatggtacaccaagtacctgaacaaccctctaggaagggctgcttctcttctcatcacactcacaatagggtggcctttgtatttagccttcaatgtctctggcagaccctatgatggttttgctagccactaccacccttatgctcccatatattcaaatcgtgagaggcttttgatctatgtctctgatgttgctttgttttctgtgacttacttgctctaccgtgttgcaactatgaaagggttggtttggctgctatgtgtttatggggtgccattgctcattgtgaacggttttcttgtgaccatcacatatctgcagcacacacactatgccttgcctcactatgattcatcagaatgggattggctgaggggtgctttggcaactatggacagagattatggaattctgaacaaggtgtttcaccacataactgatactcatgtggctcaccatcttttctctacaatgccacattaccatgcaacggaggcaaccaatgcaatgaagccaatattgggtgagtactaccgatttgatgacacaccattttacaaggcactgtggagagaagcaagagagtgcctctatgtggagccagatgaaggaacatccgagaagggcgtgtattggtacaggaacaagtattga

SEQ ID NO: 4 - protein, 387 aa, Glycine max
MGLAKETIMGGGGRVAKVEIQQKKPLSRVPNTKPPFTVGQLKKAIPPHCFQRSLLTSLSYVVYDLSLAFIFYIATTYFHLLPHPFSLIAWPIYWVLQGCILTGVWVIAHECGHHAFSKYPWVDDVMGLTVHSALLVPYFSWKISHRRHHSNTGSLDRDEVFVPKPKSKVAWYTKYLNNPLGRAASLLITLTIGWPLYLAFNVSGRPYDGFASHYHPYAPIYSNRERLLIYVSDVALFSVTYLLYRVATMKGLVWLLCVYGVPLLIVNGFLVTITYLQHTHYALPHYDSSEWDWLRGALATMDRDYGILNKVFHHITDTHVAHHLFSTMPHYHATEATNAMKPILGEYYRFDDTPFYKALWREARECLYVEPDEGTSEKGVYWYRNKY

SEQ ID NO: 5 - DNA, 1152 bp, Glycine max
atgggggctggtggccgaactgctgttcctcctgccaacaggaagtcagaggctgaccctttgaagcgggtaccatttgaaaaacctcagtttagtctcagccagattaagaaggccattccacctcactgtttccagcgctctgttctccgctcattctcctatgttgtttatgacctcaccatagccttctgcctctattatgttgccacccattacttccacctccttcccggtcctctctctttcgtggcatggccaatctattgggctgtccagggttgcatccttactggtgtttgggtcattgcccatgagtgtggtcaccatgcattcagtgactaccagctgcttgatgatattgttggccttatcctccactccgctctcctagtcccgtacttttcatggaaatacagccatcgccgtcaccactccaacacaggttctcttgagcgagatgaagtatttgtgccaaagcagaagtccagtatcatgtggtactctaaataccttaacaatccaccaggcagagtcctcactcttgccgtcaccctcacgcttggttggcccttgtacttggcttttaatgtttctggaaggccttatgatagatttgcttgccactatgacccttatggtcccatttactctgaccgagaacgacttcaaatatatatatcagatgcaggagtacttgcagtatgctatggccttttctgtcttgccatggcaaaagggcttgcctgggtggtgtgtgtttatggagttccattgcttgtggtcaatggatttttggtgttgattacatttttgcagcacactcaccctgcattgccacactacacttcctctgagtgggactggttgagaggagctttagcaacagtggatagagattatggaatcctgaacaaggtcttccataatattacagacactcatgtagctcatcacttgttctccacaatgccacattatcatgcaatggaggcgacaaaggcaataaagcccatcttgggagagtattatcggtttgatgggactccatttgtcaaggcaatgtggagagaggcaagagagtgtatttatgtggagccagatcaaagtactcagagcaaaggtgtattttggtacaacaataagttgtga

SEQ ID NO: 6 - protein, 383 aa, Glycine max
MGAGGRTAVPPANRKSEADPLKRVPFEKPQFSLSQIKKAIPPHCFQRSVLRSFSYVVYDLTIAFCLYYVATHYFHLLPGPLSFVAWPIYWAVQGCILTGVWVIAHECGHHAFSDYQLLDDIVGLILHSALLVPYFSWKYSHRRHHSNTGSLERDEVFVPKQKSSIMWYSKYLNNPPGRVLTLAVTLTLGWPLYLAFNVSGRPYDRFACHYDPYGPIYSDRERLQIYISDAGVLAVCYGLFCLAMAKGLAWVVCVYGVPLLVVNGFLVLITFLQHTHPALPHYTSSEWDWLRGALATVDRDYGILNKVFHNITDTHVAHHLFSTMPHYHAMEATKAIKPILGEYYRFDGTPFVKAMWREARECIYVEPDQSTQSKGVFWYNNKL

SEQ ID NO: 7 - DNA, 1176 bp, Glycine max
atggctctgagactgaaccctatccccacccaaaccttctccctcccccaaatggccagtctcagatctcccaggttccgcatggcctccaccctccgctccggttccaaagaggttgaaaatattaagaagccattcactcctcccagagaagtgcatgttcaagtaacccactctatgcctcctcagaagattgagattttcaaatctttggaggattgggctgagcagaacatcttgactcatcttaaacctgttgaaaaatgttggcaaccacaagattttttaccggatccttcctctgatggatttgaagagcaagtgaaggaactgagagagagggcaaaggagcttccagatgattactttgttgttctggtcggagacatgatcacagaggaagccctgcctacttaccaaacaatgttaaatactttggatggagttcgtgatgaaacaggtgccagccttacttcctgggcaatttggacaagggcatggactgctgaagaaaacagacacggtgatcttcttaacaaatatctttacttgagtggtcgagttgacatgaaacaaattgaaaagacaattcagtaccttattgggtctggaatggatcctcgaaccgagaacagcccctaccttggtttcatttacacttcatttcaagagagggcaaccttcatatcccacggaaacacagccaggcttgctaaggagcacggcgatataaagttggcccagatctgcggcatgattgcctcagatgagaaacgccatgagactgcatacacgaagatagtggaaaagctatttgaggtcgatcctgacggtacagttatggcgtttgccgacatgatgaggaagaagattgccatgccagcacacctcatgtatgacggccgtgatgacaacctgtttgatagctactcttcggtcgcgcagcgcattggggtctacaccgccaaggactatgctgacatacttgagtttctggtggggaggtggaaggtggagcagctaactggactttcaggcgagggaagaaaggctcaagaatacatttgcgggctgccgccaagaatcagaaggttggaggagagagctcaagcaagagtcaaggagtcgtcaacacttaaattcagttggattcatgacagggaagtactactctaa

SEQ ID NO: 8 - protein, 391 aa, Glycine max
MALRLNPIPTQTFSLPQMASLRSPRFRMASTLRSGSKEVENIKKPFTPPREVHVQVTHSMPPQKIEIFKSLEDWAEQNILTHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLFDSYSSVAQRIGVYTAKDYADILEFLVGRWKVEQLTGLSGEGRKAQEYICGLPPRIRRLEERAQARVKESSTLKFSWIHDREVLL

SEQ ID NO: 9 - DNA, 1209 bp, Glycine max
atgcttccattgcttcatctgactcactcatcaatggctctgagactgaaccctatccccacccaaaccttctccctcccccaaatgcccagcctcagatctccccgcttccgcatggcttccaccctccgctccggttccaaagaggttgaaaatattaagaagccattcactcctcccagagaagtgcatgttcaagtaacccactctatgcctccccagaagattgagattttcaaatctttggaggattgggctgaccagaacatcttgactcatcttaaacctgtagaaaaatgttggcaaccacaggattttttacccgacccctcctcagatggatttgaagagcaagtgaaggaactgagagagagagcaaaggagattccagatgattactttgttgttcttgtcggagacatgatcacagaggaagctctgcctacttaccaaactatgttaaatactttggatggagttcgtgatgaaacaggtgccagccttacttcctgggcaatttggacaagggcatggactgctgaagaaaacagacacggtgatcttcttaacaaatatctgtacttgagtggacgagttgacatgaaacaaattgagaagacaattcagtaccttattgggtctgggatggatcctcggaccgagaacagcccctaccttggtttcatttacacttcatttcaagagagggcaaccttcatatcccacggaaacacggccaggcttgcgaaggagcatggtgacataaaattggcacagatctgcggcatgattgcctcagatgagaagcgccacgagactgcatacacaaagatagtggaaaagctgtttgaggttgatcctgatggtacagttatggcatttgccgacatgatgaggaagaagattgctatgccagcacaccttatgtatgacggccgcgacgacaacctgtttgataactactctgccgtcgcgcagcgcattggggtctacactgcaaaggactatgctgacatactcgaatttctggtggggaggtggaaggtggagcagctaaccggactttcaggtgagggaagaaaggctcaggaatacgtttgtgggctgccaccaagaatcagaaggttggaggagagagctcaagcaagaggcaaggagtcgtcaacacttaaattcagttggattcatgacagggaagtactactctaa

SEQ ID NO: 10 - protein, 402 aa, Glycine max
MLPLLHLTHSSMALRLNPIPTQTFSLPQMPSLRSPRFRMASTLRSGSKEVENIKKPFTPPREVHVQVTHSMPPQKIEIFKSLEDWADQNILTHLKPVEKCWQPQDFLPDPSSDGFEEQVKELRERAKEIPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLFDNYSAVAQRIGVYTAKDYADILEFLVGRWKVEQLTGLSGEGRKAQEYVCGLPPRIRRLEERAQARGKESSTLKFSWIHDREVLL

SEQ ID NO: 11 - DNA, 1131 bp, Glycine max
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattgtggccatggaagcttttcagacagcccttttctaaatagcctggtgggacacatcttgcattcctcaattcttgtgccataccatggatggagaattagccacagaactcaccatcaaaatcatggacacattgagaaggatgaatcctgggttccattaaccgagaagatttacaagaatctagacaacatgacaagacttgttagattcactgtgccatttccattgtttgtgtatccaatttatttgttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattggatatttgttatgtggctggactttgtcacatacttgcatcaccatggtcatcatcagaaactgccttggtatcgcggcaaggaatggagttatttaagaggtggtctcacaactgtggatcgtgactatggttggatcaataacattcaccatgacattggcacccatgttattcaccatcttttccctcaaattcctcattatcacctcgttgaagcgacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 12 - protein, 376 aa, Glycine max
MVKDTKPLAYAANNGYQKEAFDPSAPPPFKIAEIRVAIPKHCWVKNPWRSLSYVLRDVLVIAALMAAASHFNNWLLWLIYWPIQGTMFWALFVLGHDCGHGSFSDSPFLNSLVGHILHSSILVPYHGWRISHRTHHQNHGHIEKDESWVPLTEKIYKNLDNMTRLVRFTVPFPLFVYPIYLFSRSPGKEGSHFNPYSNLFPPSERKGIAISTLCWVTMFSMLIYLSFITSPVLLLKLYGIPYWIFVMWLDFVTYLHHHGHHQKLPWYRGKEWSYLRGGLTTVDRDYGWINNIHHDIGTHVIHHLFPQIPHYHLVEATQAAKSVLGEYYREPERSAPLPFHLIKYLIQSMRQDHFVSDTGDVVYYQTDSLHLHSHRD

SEQ ID NO: 13 - DNA, 1143 bp, Glycine max
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattggatatttgttatgtggctggactttgtcacatacttgcatcaccatggtcaccaccagaaactgccttggtaccgcggcaaggaatggagttatttaagaggtggcctcaccactgtggatcgtgactatggttggatcaataacattcaccatgacattggcacccatgttatccaccatcttttcccccaaattcctcattatcacctcgttgaagcgacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 14 - protein, 380 aa, Glycine max
MVKDTKPLAYAANNGYQQKGSSFDFDPSAPPPFKIAEIRASIPKHCWVKNPWRSLSYVLRDVLVIAALVAAAIHFDNWLLWLIYCPIQGTMFWALFVLGHDCGHGSFSDSPLLNSLVGHILHSSILVPYHGWRISHRTHHQNHGHIEKDESWVPLTEKIYKNLDSMTRLIRFTVPFPLFVYPIYLFSRSPGKEGSHFNPYSNLFPPSERKGIAISTLCWATMFSLLIYLSFITSPLLVLKLYGIPYWIFVMWLDFVTYLHHHGHHQKLPWYRGKEWSYLRGGLTTVDRDYGWINNIHHDIGTHVIHHLFPQIPHYHLVEATQAAKPVLGDYYREPERSAPLPFHLIKYLIQSMRQDHFVSDTGDVVYYQTDSLLLHSQRD

SEQ ID NO: 15 - DNA, 1143 bp, Glycine max
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattgtggtcatggaagtttttcaaacagtcctttgttgaacagcattgtgggccacatcttgcactcttcaattcttgtaccataccatggatggagaattagccacaggactcaccatcagaaccatggccatgttgagaaggatgaatcatgggttccgcttacagagaaagtttacaagaatctagacaacatgacaagaatgatgagattcactcttcctttccccatctttgcataccccttttatttgtggagcagaagccctggaaaagaaggctctcatttcaacccttacagcaacttgttctctcctggtgagagaagagatgtgctaacttcaactctgtgttggggcatcatgctttctgtgcttctctatctttccctcacaatgggtccactttttatgctcaagctctatggggttccctatttgatcttcgtcatgtggctggatttcgtcacgtacttgcatcatcatggttacaagcagaaactgccttggtaccgtggccaggaatggagttatctaaggggtggtcttacaacagtagatcgcgactatggttggatcaacaacattcaccatgacattggcacccatgttatccatcaccttttccctcaaattccacattatcatttaatcgaagcgactaaagcagcaaaggcagtgctaggaaagtattatcgtgagcctcagaaatctgggccattgccacttcatctaataaagtacttgctccacagcataagtcaggatcacttcgttagcgactctggcgacattgtgtactaccagactgattcccagctccacaaagattcttggacccagtccaactaa

SEQ ID NO: 16 - protein, 380 aa, Glycine max
MVQAQPLQHVGNGAGKEDQAYFDPSAPPPFKIANIRAAIPKHCWEKNTLRSLSYVLRDVLVVTALVAAAIGFNSWFFWPLYWPAQGTMFWALFVLGHDCGHGSFSNSPLLNSIVGHILHSSILVPYHGWRISHRTHHQNHGHVEKDESWVPLTEKVYKNLDNMTRMMRFTLPFPIFAYPFYLWSRSPGKEGSHFNPYSNLFSPGERRDVLTSTLCWGIMLSVLLYLSLTMGPLFMLKLYGVPYLIFVMWLDFVTYLHHHGYKQKLPWYRGQEWSYLRGGLTTVDRDYGWINNIHHDIGTHVIHHLFPQIPHYHLIEATKAAKAVLGKYYREPQKSGPLPLHLIKYLLHSISQDHFVSDSGDIVYYQTDSQLHKDSWTQSN

SEQ ID NO: 17 - DNA, 1251 bp, Glycine max
atggtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgccgtgattggcttttacgtgactgcaaaactggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacaacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgaggggcaggactgagtggaggcccaaacctgtgaacaactttggtgttgtgaaccaggttccagcagaaagcacctaa

SEQ ID NO: 18 - protein, 416 aa, Glycine max
MVATAATSSFFPVTSPSPDSGGAGSKLGGGPANLGGLKSKSASSGGLKAKAQAPSKINGTTVVTSKESFKHDDDLPSPPPRTFINQLPDWSMLLAAITTIFLAAEKQWMMLDWKPRRPDMLIDPFGIGKIVQDGLVFRENFSIRSYEIGADRTASIETVMNHLQETALNHVKSAGLLGDGFGSTPEMCKKNLIWVVTRMQVVVERYPTWGDIVQVDTWVSGSGKNGMRRDWLLRDCKTGEILTRASSVWVMMNKLTRRLSKIPEEVRQEIGSYFVDSDPILEEDNRKLTKLDDNTADYIRTGLSPRWSDLDINQHVNNVKYIGWILESAPQPILESHELSSMTLEYRRECGRDSVLDSLTAVSGADMGNLAHSGHVECKHLLRLENGAEIVRGRTEWRPKPVNNFGVVNQVPAEST

SEQ ID NO: 19 - DNA, 1251 bp, Glycine max
atggtggcaacagctgcaacttcatcatttttccctgttacttcaccctcgccggactctggtggagcaggcagcaaacttggtggtgggcctgcgaaccttggaggtctaaaatccaaatctgtgtcttctggtggcttgaaggcaaaggcacaagcccctttgaaaattaatggaaccacagttgttacatctaaagaaatcttgaagcatgaggatgatctaccttcacctccccccaggacttttatcaaccagttacctgattggagcatgcttcttgctgccattacaacaattttcttggcagctgaaaagcagtggatgatgcttgattggaagccaaggcgacctgacatgcttattgacccctttgggataggaaaaattgttcaggatggtctcgtgttccgtgaaaacttttctattagatcatatgagattggtgctgatcgaaccgcatctatagaaacagtaatgaaccatttgcaagaaactgcacttaatcatgttaaaagtgctgggcttcttggtgatggcttcggttccacgccagaaatgtgcaaaaagaacttgatatgggtagttactcggatgcaggttgtggtggatcgctatcctacatggggtgacgtagttcaagtagacacctgggcttctggatcagggaagaatgctatgcgccgtgattgggttttacgtgactgcaaaactggtgaaatcttgacaagagcttccagtgtttgggtcatgatgaataagctgacacggaggctgtctaaaattccagaagaagtcagacaggagataggatcttattttgtggattctgatccaattctagaagaggataacagaaaactgactaaacttgacgacaacacagcagattatattcgtaccggtttaagttctaggtggagtgatctagatatcaatcagcatgtcaacaatgtgaagtacattgactggattctggagagtgctccacagccaatcttggagagtcatgagctttcttccgtgactttagagtataggagggagtgtggtagggacagtgtgctggattccctgactgctgtatctggggccgacatgggcaatctagctcacagtggacatgttgagtgcaagcatttgcttcgactcgaaaatggtgctgagattgtgaggggcaggactgagtggaggcccaaacctatgaacaacattggtgttgtgaaccaggttccagcagaaagcacctaa

SEQ ID NO: 20 - protein, 416 aa, Glycine max
MVATAATSSFFPVTSPSPDSGGAGSKLGGGPANLGGLKSKSVSSGGLKAKAQAPLKINGTTVVTSKEILKHEDDLPSPPPRTFINQLPDWSMLLAAITTIFLAAEKQWMMLDWKPRRPDMLIDPFGIGKIVQDGLVFRENFSIRSYEIGADRTASIETVMNHLQETALNHVKSAGLLGDGFGSTPEMCKKNLIWVVTRMQVVVDRYPTWGDVVQVDTWASGSGKNAMRRDWVLRDCKTGEILTRASSVWVMMNKLTRRLSKIPEEVRQEIGSYFVDSDPILEEDNRKLTKLDDNTADYIRTGLSSRWSDLDINQHVNNVKYIDWILESAPQPILESHELSSVTLEYRRECGRDSVLDSLTAVSGADMGNLAHSGHVECKHLLRLENGAEIVRGRTEWRPKPMNNIGVVNQVPAEST

SEQ ID NO: 21 - DNA, 21 bp, artificial sequence
  amiRNA
tgagggaaaagggttgaggaa

SEQ ID NO: 22 - DNA, 21 bp, artificial sequence
  amiRNA
tccacataaatacactctctt

SEQ ID NO: 23 - DNA, 21 bp, artificial sequence
  amiRNA
ttagccatgtcaaccctccca

SEQ ID NO: 24 - DNA, 21 bp, artificial sequence
  amiRNA
tccaagaacaaagagagccca

SEQ ID NO: 25 - DNA, 21 bp, artificial sequence
  amiRNA
ttccaatccagcatcatccac

SEQ ID NO: 26 - DNA, 21 bp, artificial sequence
  STAR sequence
ttcctcaacccaattccctct

SEQ ID NO: 27 - DNA, 21 bp, artificial sequence
  STAR sequence
ttactcaacccttttccctca

SEQ ID NO: 28 - DNA, 21 bp, artificial sequence
  STARsequence
ttactcaacccttttccctca

SEQ ID NO: 29 - DNA, 21 bp, artificial sequence
  STARsequence
tggaagggttgacatggctaa

SEQ ID NO: 30 - DNA, 21 bp, artificial sequence
  STARsequence
tgggctctcttgattcttgga

SEQ ID NO: 31 - DNA, 21 bp, artificial sequence
  STARsequence
gtggatgatgcctgattggat

SEQ ID NO: 32 - DNA, 11024 bp, artificial sequence
  vector
  misc_feature (3313)..(3313): n is a, c, g, or t
ggccgcttctagctagctagggtttgggtagtgagtgtaataaagttgcaaagtttttggttaggttacgttttgaccttattattatagttcaaagggaaacattaattaagggattatgaagttcctcaacccaattccctcttgaggatcttactgggtgaattgagctgcttagctatggatcccacagttctacccatcaataagtgcttttgtggtagtcttgtggcttccatatctggggagcttcatttgcctttatagtattaaccttctgagggaaaagggttgaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgc

SEQ ID NO: 33 - DNA, 10680 bp, artificial sequence
  vector
  misc_feature (2969)..(2969): n is a, c, g, or t
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcgcaagggcgaattctgcagatatccatcacactggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgc

SEQ ID NO: 34 - DNA, 11636 bp, artificial sequence
  vector
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcagttttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccaattctgcagatatccatcacactgaagcttttctagctagctagggtttgggtagtgagtgtaataaagttgcaaagtttttggttaggttacgttttgaccttattattatagttcaaagggaaacattaattaaaggggattatgaagaagagagtgtacctatgtggttgaggatcttactgggtgaattgagctgcttagctatggatcccacagttctacccatcaataagtgcttttgtggtagtcttgtggcttccatatctggggagcttcatttgcctttatagtattaaccttctccacataaatacactctcttcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 35 - DNA, 11251 bp, artificial sequence
  vector
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcagttttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccaattctgcagatatccatcacactgggatccgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttagccatgtcaaccctcccacttatgcatcttatatctctccacctccaggattttaagccctagtggaagggttgacatggctaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 36 - DNA, 11026 bp, artificial sequence
  vector
  misc_feature (3315)..(3315): n is a, c, g, or t
ggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgc

SEQ ID NO: 37 - DNA, 11037 bp, artificial sequence
  vector
  misc_feature (3326)..(3326): n is a, c, g, or t
ggccgcgaattcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctaagcttgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgc

SEQ ID NO: 38 - DNA, 8060 bp, artificial sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctggggcccaagc

SEQ ID NO: 39 - DNA, 8059 bp, artificial sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggcccaagc

SEQ ID NO: 40 - DNA, 9025 bp, artificial sequence
  vector
ggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctgg

SEQ ID NO: 41 - DNA, 9025 bp, artificial sequence
  vector
ggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgg

SEQ ID NO: 42 - DNA, 12953 bp, artificial sequence
  vector
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagttcctcaacccaattccctcttgaggatcttactgggtgaattgagctgcttagctatggatcccacagttctacccatcaataagtgcttttgtggtagtcttgtggcttccatatctggggagcttcatttgcctttatagtattaaccttctgagggaaaagggttgaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgaattcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctaagcttttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 43 - DNA, 9644 bp, artificial sequence
  vector
ggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcgcaagggcgaattctgcagatatccatcacacttgggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgg

SEQ ID NO: 44 - DNA, 1152 bp, Arabidopsis thaliana
atgggtgcaggtggaagaatgccggttcctacttcttccaagaaatcggaaaccgacaccacaaagcgtgtgccgtgcgagaaaccgcctttctcggtgggagatctgaagaaagcaatcccgccgcattgtttcaaacgctcaatccctcgctctttctcctaccttatcagtgacatcattatagcctcatgcttctactacgtcgccaccaattacttctctctcctccctcagcctctctcttacttggcttggccactctattgggcctgtcaaggctgtgtcctaactggtatctgggtcatagcccacgaatgcggtcaccacgcattcagcgactaccaatggctggatgacacagttggtcttatcttccattccttcctcctcgtcccttacttctcctggaagtatagtcatcgccgtcaccattccaacactggatccctcgaaagagatgaagtatttgtcccaaagcagaaatcagcaatcaagtggtacgggaaatacctcaacaaccctcttggacgcatcatgatgttaaccgtccagtttgtcctcgggtggcccttgtacttagcctttaacgtctctggcagaccgtatgacgggttcgcttgccatttcttccccaacgctcccatctacaatgaccgagaacgcctccagatatacctctctgatgcgggtattctagccgtctgttttggtctttaccgttacgctgctgcacaagggatggcctcgatgatctgcctctacggagtaccgcttctgatagtgaatgcgttcctcgtcttgatcacttacttgcagcacactcatccctcgttgcctcactacgattcatcagagtgggactggctcaggggagctttggctaccgtagacagagactacggaatcttgaacaaggtgttccacaacattacagacacacacgtggctcatcacctgttctcgacaatgccgcattataacgcaatggaagctacaaaggcgataaagccaattctgggagactattaccagttcgatggaacaccgtggtatgtagcgatgtatagggaggcaaaggagtgtatctatgtagaaccggacagggaaggtgacaagaaaggtgtgtactggtacaacaataagttatga

SEQ ID NO: 45 - protein, 383 aa, Arabidopsis thaliana
MGAGGRMPVPTSSKKSETDTTKRVPCEKPPFSVGDLKKAIPPHCFKRSIPRSFSYLISDIIIASCFYYVATNYFSLLPQPLSYLAWPLYWACQGCVLTGIWVIAHECGHHAFSDYQWLDDTVGLIFHSFLLVPYFSWKYSHRRHHSNTGSLERDEVFVPKQKSAIKWYGKYLNNPLGRIMMLTVQFVLGWPLYLAFNVSGRPYDGFACHFFPNAPIYNDRERLQIYLSDAGILAVCFGLYRYAAAQGMASMICLYGVPLLIVNAFLVLITYLQHTHPSLPHYDSSEWDWLRGALATVDRDYGILNKVFHNITDTHVAHHLFSTMPHYNAMEATKAIKPILGDYYQFDGTPWYVAMYREAKECIYVEPDREGDKKGVYWYNNKL

SEQ ID NO: 46 - DNA, 1161 bp, Arabidopsis thaliana
atggttgttgctatggaccaacgcaccaatgtgaacggagatcccggcgccggagaccggaagaaagaagaaaggtttgatccgagtgcacaaccaccgttcaagatcggagatataagggcggcgattcctaagcactgttgggttaagagtcctttgagatcaatgagttacgtcgtcagagacattatcgccgtcgcggctttggccatcgctgccgtgtatgttgatagctggttcctttggcctctttattgggccgcccaaggaacacttttctgggccatctttgttctcggccacgactgtggacatgggagtttctcagacattcctctactgaatagtgtggttggtcacattcttcattctttcatcctcgttccttaccatggttggagaataagccaccggacacaccaccagaaccatggccatgttgaaaacgacgagtcatgggttccgttaccagaaagggtgtacaagaaattgccccacagtactcggatgctcagatacactgtccctctccccatgctcgcatatcctctctatttgtgctacagaagtcctggaaaagaaggatcacattttaacccatacagtagtttatttgctccaagcgagagaaagcttattgcaacttcaactacttgttggtccataatgttcgtcagtcttatcgctctatctttcgtcttcggtccactcgcggttcttaaagtctacggtgtaccgtacattatctttgtgatgtggttggatgctgtcacgtatttgcatcatcatggtcacgatgagaagttgccttggtatagaggcaaggaatggagttatctacgtggaggattaacaacaattgatagagattacggaatctttaacaacattcatcacgacattggaactcacgtgatccatcatctcttcccacaaatccctcactatcacttggtcgacgccacgaaagcagctaaacatgtgttgggaagatactacagagaaccaaagacgtcaggagcaataccgatccacttggtggagagtttggtcgcaagtattaagaaagatcattacgtcagcgacactggtgatattgtcttctacgagacagatccagatctctacgtttacgcttctgacaaatctaaaatcaattaa

SEQ ID NO: 47 - protein, 386 aa, Arabidopsis thaliana
MVVAMDQRTNVNGDPGAGDRKKEERFDPSAQPPFKIGDIRAAIPKHCWVKSPLRSMSYVVRDIIAVAALAIAAVYVDSWFLWPLYWAAQGTLFWAIFVLGHDCGHGSFSDIPLLNSVVGHILHSFILVPYHGWRISHRTHHQNHGHVENDESWVPLPERVYKKLPHSTRMLRYTVPLPMLAYPLYLCYRSPGKEGSHFNPYSSLFAPSERKLIATSTTCWSIMFVSLIALSFVFGPLAVLKVYGVPYIIFVMWLDAVTYLHHHGHDEKLPWYRGKEWSYLRGGLTTIDRDYGIFNNIHHDIGTHVIHHLFPQIPHYHLVDATKAAKHVLGRYYREPKTSGAIPIHLVESLVASIKKDHYVSDTGDIVFYETDPDLYVYASDKSKIN

SEQ ID NO: 48 - DNA, 1521 bp, Arabidopsis thaliana
atgacgtccgttaacgttaagctcctttaccgttacgtcttaaccaactttttcaacctctgtttgttcccgttaacggcgttcctcgccggaaaagcctctcggcttaccataaacgatctccacaacttcctttcctatctccaacacaaccttataacagtaactttactctttgctttcactgttttcggtttggttctctacatcgtaacccgacccaatccggtttatctcgttgactactcgtgttaccttccaccaccgcatctcaaagttagtgtctctaaagtcatggatattttctaccaaataagaaaagctgatacttcttcacggaacgtggcatgtgatgatccgtcctcgctcgatttcctgaggaagattcaagagcgttcaggtctaggtgatgagacgtacagtcctgagggactcattcacgtaccaccgcggaagacttttgcagcgtcacgtgaagagacagagaaggttatcatcggtgcgctcgaaaatctattcgagaacaccaaagttaaccctagagagattggtatacttgtggtgaactcaagcatgtttaatccaactccttcgctatccgctatggtcgttaatactttcaagctccgaagcaacatcaaaagctttaatctaggaggaatgggttgtagtgctggtgttattgccattgatttggctaaagacttgttgcatgttcataaaaacacttatgctcttgtggtgagcactgagaacatcacacaaggcatttatgctggagaaaatagatcaatgatggttagcaattgcttgtttcgtgttggtggggccgcgattttgctctctaacaagtcgggagaccggagacggtccaagtacaagctagttcacacggtccgaacgcatactggagctgatgacaagtcttttcgatgtgtgcaacaagaagacgatgagagcggcaaaatcggagtttgtctgtcaaaggacataaccaatgttgcggggacaacacttacgaaaaatatagcaacattgggtccgttgattcttcctttaagcgaaaagtttctttttttcgctaccttcgtcgccaagaaacttctaaaggataaaatcaagcattactatgttccggatttcaagcttgctgttgaccatttctgtattcatgccggaggcagagccgtgatcgatgagctagagaagaacttaggactatcgccgatcgatgtggaggcatctagatcaacgttacatagatttgggaatacttcatctagctcaatttggtatgaattagcatacatagaggcaaagggaagaatgaagaaagggaataaagcttggcagattgctttaggatcagggtttaagtgtaatagtgcggtttgggtggctctacgcaatgtcaaggcatcggcaaatagtccttggcaacattgcatcgatagatatccggttaaaattgattctgatttgtcaaagtcaaagactcatgtccaaaacggtcggtcctaa

SEQ ID NO: 49 - protein, 506 aa, Arabidopsis thaliana
MTSVNVKLLYRYVLTNFFNLCLFPLTAFLAGKASRLTINDLHNFLSYLQHNLITVTLLFAFTVFGLVLYIVTRPNPVYLVDYSCYLPPPHLKVSVSKVMDIFYQIRKADTSSRNVACDDPSSLDFLRKIQERSGLGDETYSPEGLIHVPPRKTFAASREETEKVIIGALENLFENTKVNPREIGILVVNSSMFNPTPSLSAMVVNTFKLRSNIKSFNLGGMGCSAGVIAIDLAKDLLHVHKNTYALVVSTENITQGIYAGENRSMMVSNCLFRVGGAAILLSNKSGDRRRSKYKLVHTVRTHTGADDKSFRCVQQEDDESGKIGVCLSKDITNVAGTTLTKNIATLGPLILPLSEKFLFFATFVAKKLLKDKIKHYYVPDFKLAVDHFCIHAGGRAVIDELEKNLGLSPIDVEASRSTLHRFGNTSSSSIWYELAYIEAKGRMKKGNKAWQIALGSGFKCNSAVWVALRNVKASANSPWQHCIDRYPVKIDSDLSKSKTHVQNGRS

SEQ ID NO: 50 - DNA, 1155 bp, Brassica napus
atgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttagccttcaacgtctcgggaagaccttacgacggcggcttcgcttgccatttccaccccaacgctcccatctacaacgaccgcgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcatcatctgttctccacgatgccgcattatcacgcgatggaagctactaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 51 - protein, 384 aa, Brassica napus
MGAGGRMQVSPPSKKSETDTIKRVPCETPPFTVGELKKAIPPHCFKRSIPRSFSYLIWDIIIASCFYYVATTYFPLLPHPLSYFAWPLYWACQGCVLTGVWVIAHECGHHAFSDYQWLDDTVGLIFHSFLLVPYFSWKYSHRRHHSNTGSLERDEVFVPKKKSDIKWYGKYLNNPLGRTVMLTVQFTLGWPLYLAFNVSGRPYDGGFACHFHPNAPIYNDRERLQIYISDAGILAVCYGLFRYAAAQGVASMVCFYGVPLLIVNGFLVLITYLQHTHPSLPHYDSSEWDWLRGALATVDRDYGILNKVFHNITDTHVAHHLFSTMPHYHAMEATKAIKPILGEYYQFDGTPVVKAMWREAKECIYVEPDRQGEKKGVFWYNNKL

SEQ ID NO: 52 - DNA, 1155 bp, Brassica napus
atgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagccttcaacgtctcggggagaccttacgacggcggcttcgcttgccatttccaccccaacgctcccatctacaacgaccgtgagcgtctccagatatacatctccgacgctggcatcctcgccgtctgctacggtctctaccgctacgctgctgtccaaggagttgcctcgatggtctgcttctacggagttcctcttctgattgtcaacgggttcttagttttgatcacttacttgcagcacacgcatccttccctgcctcactatgactcgtctgagtgggattggttgaggggagctttggccaccgttgacagagactacggaatcttgaacaaggtcttccacaatatcacggacacgcacgtggcgcatcacctgttctcgaccatgccgcattatcatgcgatggaagctacgaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 53 - protein, 384 aa, Brassica napus
MGAGGRMQVSPPSKKSETDNIKRVPCETPPFTVGELKKAIPPHCFKRSIPRSFSYLIWDIIIASCFYYVATTYFPLLPHPLSYFAWPLYWACQGCVLTGVWVIAHECGHHAFSDYQWLDDTVGLIFHSFLLVPYFSWKYSHRRHHSNTGSLERDEVFVPKKKSDIKWYGKYLNNPLGRTVMLTVQFTLGWPLYLAFNVSGRPYDGGFACHFHPNAPIYNDRERLQIYISDAGILAVCYGLYRYAAVQGVASMVCFYGVPLLIVNGFLVLITYLQHTHPSLPHYDSSEWDWLRGALATVDRDYGILNKVFHNITDTHVAHHLFSTMPHYHAMEATKAIKPILGEYYQFDGTPVVKAMWREAKECIYVEPDRQGEKKGVFWYNNKL

SEQ ID NO: 54 - DNA, 1155 bp, Brassica napus
atgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttagccttcaacgtctcgggaagaccttacgacggcggcttcgcttgccatttccaccccaacgctcccatctacaacgaccgcgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcaccatctgttctccacgatgccgcattatcacgcgatggaagctaccaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 55 - protein, 384 aa, Brassica napus
MGAGGRMQVSPPSKKSETDNIKRVPCETPPFTVGELKKAIPPHCFKRSIPRSFSYLIWDIIIASCFYYVATTYFPLLPHPLSYFAWPLYWACQGCVLTGVWVIAHECGHHAFSDYQWLDDTVGLIFHSFLLVPYFSWKYSHRRHHSNTGSLERDEVFVPKKKSDIKWYGKYLNNPLGRTVMLTVQFTLGWPLYLAFNVSGRPYDGGFACHFHPNAPIYNDRERLQIYISDAGILAVCYGLFRYAAAQGVASMVCFYGVPLLIVNGFLVLITYLQHTHPSLPHYDSSEWDWLRGALATVDRDYGILNKVFHNITDTHVAHHLFSTMPHYHAMEATKAIKPILGEYYQFDGTPVVKAMWREAKECIYVEPDRQGEKKGVFWYNNKL

SEQ ID NO: 56 - DNA, 1155 bp, Brassica napus
atgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagccttcaacgtctcggggagaccttacgacggcggcttcgcttgccatttccaccccaacgctcccatctacaacgaccgtgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcatcatctgttctccacgatgccgcattatcacgcgatggaagctaccaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 57 - protein, 384 aa, Brassica napus
MGAGGRMQVSPPSKKSETDNIKRVPCETPPFTVGELKKAIPPHCFKRSIPRSFSYLIWDIIIASCFYYVATTYFPLLPHPLSYFAWSLYWACQGCVLTGVWVIAHECGHHAFSDYQWLDDTVGLIFHSFLLVPYFSWKYSHRRHHSNTGSLERDEVFVPKKKSDIKWYGKYLNNPLGRTVMLTVQFTLGWPLYLAFNVSGRPYDGGFACHFHPNAPIYNDRERLQIYISDAGILAVCYGLFRYAAAQGVASMVCFYGVPLLIVNGFLVLITYLQHTHPSLPHYDSSEWDWLRGALATVDRDYGILNKVFHNITDTHVAHHLFSTMPHYHAMEATKAIKPILGEYYQFDGTPVVKAMWREAKECIYVEPDRQGEKKGVFWYNNKL

SEQ ID NO: 58 - DNA, 1155 bp, Brassica napus
atgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttagccttcaacgtctctggaagaccttacagcgacggtttcgcttgccatttccacccgaacgctcccatctacaacgaccgcgagcgtctccagatatacatctctgacgctggcgtcctctccgtatgttacggtctctaccgctacgctggttcgcgaggagtggcctcgatggtctgtgtctacggagttccgcttatgattgtcaactgtttcctcgtcttgatcacttacttgcagcacacgcacccttcgctgcctcactatgattcttcggagtgggattggttgagaggagctttggctactgtggatagagactatggaatcttgaacaaggtgtttcataacatcacggacacgcacgtggcgcatcatctgttctcgacgatgccgcattataacgcgatggaagcgaccaaggcgataaagccgatacttggagagtattaccagtttgatggaacgccggtggttaaggcgatgtggagggaggcgaaggagtgtatctatgttgaaccggataggcaaggtgagaagaaaggtgtgttctggtacaacaataagttatga

SEQ ID NO: 59 - protein, 384 aa, Brassica napus
MGAGGRMQVSPPSSSPETKTLKRVPCETPPFTLGDLKKAIPPHCFKRSIPRSFSYLLFDILVSSSLYHLSTAYFPLLPHPLPYLAWPLYWACQGCVLTGLWVIAHECGHHAFSDHQWLDDAVGLVFHSFLLVPYFSWKYSHRRHHSNTGSLERDEVFVPKKKSDIKWYGKYLNNPLGRTVMLTVQFTLGWPLYLAFNVSGRPYSDGFACHFHPNAPIYNDRERLQIYISDAGVLSVCYGLYRYAGSRGVASMVCVYGVPLMIVNCFLVLITYLQHTHPSLPHYDSSEWDWLRGALATVDRDYGILNKVFHNITDTHVAHHLFSTMPHYNAMEATKAIKPILGEYYQFDGTPVVKAMWREAKECIYVEPDRQGEKKGVFWYNNKL

SEQ ID NO: 60 - DNA, 1152 bp, Brassica napus
atggttgttgctatggaccagcgcagcaatgttaacggagattccggtgcccggaaggaagaagggtttgatccaagcgcacaaccaccgtttaagatcggagatataagggcggcgattcctaagcattgctgggtgaagagtcctttgagatctatgagctacgtcaccagagacattttcgccgtcgcggctctggccatggccgccgtgtattttgatagctggttcctctggccactctactgggttgcccaaggaacccttttctgggccatcttcgttcttggccacgactgtggacatgggagtttctcagacattcctctgctgaacagtgtggttggtcacattcttcattcattcatcctcgttccttaccatggttggagaataagccatcggacacaccaccagaaccatggccatgttgaaaacgacgagtcttgggttccgttgccagaaaagttgtacaagaacttgccccatagtactcggatgctcagatacactgtccctctgcccatgctcgcttacccgatctatctgtggtacagaagtcctggaaaagaagggtcacattttaacccatacagtagtttatttgctccaagcgagaggaagcttattgcaacttcaactacttgctggtccataatgttggccactcttgtttatctatcgttcctcgttgatccagtcacagttctcaaagtctatggcgttccttacattatctttgtgatgtggttggacgctgtcacgtacttgcatcatcatggtcacgatgagaagttgccttggtacagaggcaaggaatggagttatttacgtggaggattaacaactattgatagagattacggaatcttcaacaacatccatcacgacattggaactcacgtgatccatcatcttttcccacaaatccctcactatcacttggtcgatgccacgagagcagctaaacatgtgttaggaagatactacagagagccgaagacgtcaggagcaataccgattcacttggtggagagtttggtcgcaagtattaaaaaagatcattacgtcagtgacactggtgatattgtcttctacgagacagatccagatctctacgtttatgcttctgacaaatctaaaatcaattaa

SEQ ID NO: 61 - protein, 383 aa, Brassica napus
MVVAMDQRSNVNGDSGARKEEGFDPSAQPPFKIGDIRAAIPKHCWVKSPLRSMSYVTRDIFAVAALAMAAVYFDSWFLWPLYWVAQGTLFWAIFVLGHDCGHGSFSDIPLLNSVVGHILHSFILVPYHGWRISHRTHHQNHGHVENDESWVPLPEKLYKNLPHSTRMLRYTVPLPMLAYPIYLWYRSPGKEGSHFNPYSSLFAPSERKLIATSTTCWSIMLATLVYLSFLVDPVTVLKVYGVPYIIFVMWLDAVTYLHHHGHDEKLPWYRGKEWSYLRGGLTTIDRDYGIFNNIHHDIGTHVIHHLFPQIPHYHLVDATRAAKHVLGRYYREPKTSGAIPIHLVESLVASIKKDHYVSDTGDIVFYETDPDLYVYASDKSKIN

SEQ ID NO: 62 - DNA, 1152 bp, Brassica napus
atggttgttgctatggaccagcgcagcaatgttaacggagattccggtgcccggaaggaagaagggtttgatccaagcgaacaaccaccgtttaagatcggagatatcagggcggcgattcctaagcattgttgggtgaagagtcctttgagatctatgagctacgtcgccagagacattttcgccgtcgcggctctggccatggccgccgtgtattttgatagctggttcctctggccactctactgggttgcccaaggaacccttttctgggccatcttcgttcttggccacgactgtggacatgggagtttttcagacattcctctgctgaacagtgtggttggtcacattcttcattcattcatcctcgttccttaccatggttggagaataagccatcggacacaccaccagaaccatggccatgttgaaaacgacgagtcttgggttccgttgccagaaaagttgtacaagaacttgccccatagtactcggatgctcagatacactgttcctctgcccatgctcgcttacccgatctatctgtggcacagaagtcctggaaaagaagggtcacattttaacccatacagtagtttatttgctccaagcgagaggaagcttattgcaacttcaacaacttgctggtccataatgttggccactcttgtttatctatcgttcctcgttggaccagtcacagttctcaaagtctatggcgttccttacattatctttgtgatgtggttggacgctgtcacgtacttgcatcatcatggtcacgatgagaagttgccttggtacagaggcaaggaatggagttatttacgtggaggattaacaactattgatagagattacggaatcttcaacaacatccatcacgacattggaactcacgtgatccatcatcttttcccacaaatccctcactatcacttggtcgatgccacgagagcagctaaacatgtgttaggaagatactacagagtgccgaagacgtcaggggcaataccgattcacttggtggagagtttggtcgcaagtattaaaaaagatcattacgtcagtgacactggtgatattgtcttctacgagacagatccagatctctacgtttatgcttctgacaaatctaaaatcaattaa

SEQ ID NO: 63 - protein, 383 aa, Brassica napus
MVVAMDQRSNVNGDSGARKEEGFDPSEQPPFKIGDIRAAIPKHCWVKSPLRSMSYVARDIFAVAALAMAAVYFDSWFLWPLYWVAQGTLFWAIFVLGHDCGHGSFSDIPLLNSVVGHILHSFILVPYHGWRISHRTHHQNHGHVENDESWVPLPEKLYKNLPHSTRMLRYTVPLPMLAYPIYLWHRSPGKEGSHFNPYSSLFAPSERKLIATSTTCWSIMLATLVYLSFLVGPVTVLKVYGVPYIIFVMWLDAVTYLHHHGHDEKLPWYRGKEWSYLRGGLTTIDRDYGIFNNIHHDIGTHVIHHLFPQIPHYHLVDATRAAKHVLGRYYRVPKTSGAIPIHLVESLVASIKKDHYVSDTGDIVFYETDPDLYVYASDKSKIN

SEQ ID NO: 64 - DNA, 1134 bp, Brassica napus
atggttgtcgctatggaccagcgtagcaatgcgaacggagacgaaaggtttgatccgagcgcacaaccaccgttcaagatcggagatataagggcggccattcctaagcattgttgggtaaagagtcctttgagatccatgagctatgtcgccagagacattttcgccgtcgtggctcttgccgtcgccgccgtgtattttgatagctggttcttttggcctctttattgggccgcccaaggaaccctgttctgggctatcttcgtactcggccacgactgtggacatgggagcttctcagacattccccttctgaatactgcggttggtcatattcttcattccttcattctcgttccataccatggttggagaataagccatcggacacaccaccagaaccatggccatgttgaaaacgacgagtcttgggttccgttgccagaaaaattatacaagaatttgtcccacagtacacggatgctcagatacactgtccctctccccatgctcgcttaccctctctatctgtggtacagaagtcctggtaaagaagggtcacattataacccatacagtagtttatttgccccaagcgagagaaagcttattgcaacttcaactacttgctggtcgatcatgttggccactcttgtttatctatcattcctcgttggtccagtcacagttctaaaagtctatggtgttccttacattatctttgtaatgtggttggacgctgtcacgtacttgcatcatcatggtcacgatgataagttgccttggtacagaggcaaggaatggagttatttacgtggaggattaacaactattgatagagattacgggatcttcaacaacattcatcacgatattggaactcacgtgatccatcatcttttcccacaaatccctcactatcacttggttgatgccacgaaatcagctaaacatgtgttgggaagatactacagagaaccaaagacgtcaggagcaataccgatccacttggtggaaagtttggtggcaagtattaagaaagatcattacgtcagtgacactggtgatattgtcttctacgagacagatccagatctctacgtttatgcttctgacaaatccaaaatcaactaa

SEQ ID NO: 65 - protein, 377 aa, Brassica napus
MVVAMDQRSNANGDERFDPSAQPPFKIGDIRAAIPKHCWVKSPLRSMSYVARDIFAVVALAVAAVYFDSWFFWPLYWAAQGTLFWAIFVLGHDCGHGSFSDIPLLNTAVGHILHSFILVPYHGWRISHRTHHQNHGHVENDESWVPLPEKLYKNLSHSTRMLRYTVPLPMLAYPLYLWYRSPGKEGSHYNPYSSLFAPSERKLIATSTTCWSIMLATLVYLSFLVGPVTVLKVYGVPYIIFVMWLDAVTYLHHHGHDDKLPWYRGKEWSYLRGGLTTIDRDYGIFNNIHHDIGTHVIHHLFPQIPHYHLVDATKSAKHVLGRYYREPKTSGAIPIHLVESLVASIKKDHYVSDTGDIVFYETDPDLYVYASDKSKIN

SEQ ID NO: 66 - DNA, 1521 bp, Brassica napus
atgacgtccgttaacgtaaagctcctttaccattacgtcataaccaaccttttcaacctttgcttctttccgttaacggcgatcgtcgccggaaaagcctatcggcttaccatagacgatcttcaccacttatactattcctatctccaacacaacctcataaccatcgctccactctttgccttcaccgttttcggttcggttctctacatcgcaacccggcccaaaccggtttacctcgttgagtactcatgctaccttccaccaacgcattgtagatcaagtatctccaaggtcatggatatcttttatcaagtaagaaaagctgatccttctcggaacggcacgtgcgatgactcgtcgtggcttgacttcttgaggaagattcaagaacgttcaggtctaggcgatgaaactcacgggcccgaggggctgcttcaggtccctccccggaagacttttgcggcggcgcgtgaagagacggagcaagttatcattggtgcgctagaaaatctattcaagaacaccaacgttaaccctaaagatataggtatacttgtggtgaactcaagcatgtttaatccaactccatcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctctccaacaagcctggagatcgtagacggtccaagtacgagctagttcacacggttcgaacgcataccggagctgacgacaagtcttttcgttgcgtgcaacaaggagacgatgagaacggcaaaatcggagtgagtttgtccaaggacataaccgatgttgctggtcgaacggttaagaaaaacatagcaacgttgggtccgttgattcttccgttaagcgagaaacttctttttttcgttaccttcatgggcaagaaacttttcaaagataaaatcaaacattactacgtcccggatttcaaacttgctattgaccatttttgtatacatgccggaggcagagccgtgattgatgtgctagagaagaacctagccctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcgacaaatagtccttgggaacactgcatcgacagatacccggtcaaaattgattctgattcaggtaagtcagagactcgtgtccaaaacggtcggtcctaa

SEQ ID NO: 67 - protein, 506 aa, Brassica napus
MTSVNVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 68 - DNA, 1521 bp, Brassica napus
atgacgtccgttaacgtaaagctcctttaccattacgtcataaccaaccttttcaacctttgcttctttccgttaacggcgatcgtcgccggaaaagcctatcggcttaccatagacgatcttcaccacttatactattcctatctccaacacaacctcataaccatcgctccactctttgccttcaccgttttcggttcggttctctacatcgcaacccggcccaaaccggtttacctcgttgagtactcatgctaccttccaccaacgcattgtagatcaagtatctccaaggtcatggatatcttttatcaagtaagaaaagctgatccttctcggaacggcacgtgcgatgactcgtcgtggcttgacttcttgaggaagattcaagaacgttcaggtctaggcgatgaaactcacgggcccgaggggctgcttcaggtccctccccggaagacttttgcggcggcgcgtgaagagacggagcaagttatcattggtgcgctagaaaatctattcaagaacaccaacgttaaccctaaagatataggtatacttgtggtgaactcaagcatgtttaatccaactccatcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctcttcaacaagcctggagatcgtagacggtccaagtacgagctagttcacacggttcgaacgcataccggagctgacgacaagtcttttcgttgcgtgcaacaaggagacgatgagaacggcaaaatcggagtgagtttgtccaaggacataaccgatgttgctggtcgaacggttaagaaaaacatagcaacgttgggtccgttgattcttccgttaagcgagaaacttctttttttcgttaccttcatgggcaagaaacttttcaaagataaaatcaaacattactacgtcccggatttcaaacttgctattgaccatttttgtatacatgccggaggcagagccgtgattgatgtgctagagaagaacctagccctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcgacaaatagtccttgggaacactgcatcgacagatacccggtcaaaattgattctgattcaggtaagtcagagactcgtgtccaaaacggtcggtcctaa

SEQ ID NO: 69 - protein, 506 aa, Brassica napus
MTSVNVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLFNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 70 - DNA, 1521 bp, Brassica napus
atgacgtccattaacgtaaagctcctttaccattacgtcataaccaaccttttcaacctttgcttctttccgttaacggcgatcgtcgccggaaaagcctatcggcttaccatagacgatcttcaccacttatactattcctatctccaacacaacctcataaccatcgctccactctttgccttcaccgttttcggttcggttctctacatcgcaacccggcccaaaccggtttacctcgttgagtactcatgctaccttccaccaacgcattgtagatcaagtatctccaaggtcatggatatcttttatcaagtaagaaaagctgatccttctcggaacggcacgtgcgatgactcgtcgtggcttgacttcttgaggaagattcaagaacgttcaggtctaggcgatgaaactcacgggcccgaggggctgcttcaggtccctccccggaagacttttgcggcggcgcgtgaagagacggagcaagttatcattggtgcgctagaaaatctattcaagaacaccaacgttaaccctaaagatataggtatacttgtggtgaactcaagcatgtttaatccaactccatcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctctccaacaagcctggagatcgtagacggtccaagtacgagctagttcacacggttcgaacgcataccggagctgacggcaagtcttttcgttgcgtgcaacaaggagacgatgagaacggcaaaatcggagtgagtttgtccaaggacataaccgatgttgctggtcgaacggttaagaaaaacatagcaacgttgggtccgttgattcttccgttaagcgagaaacttctttttttcgttaccttcatgggcaagaaacttttcaaagataaaatcaaacattactacgtcccggatttcaaacttgctattgaccatttttgtatacatgccggaggcagagccgtgattgatgtgctagagaagaacctagccctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcgacaaatagtccttgggaacactgcatcgacagatacccggtcaaaattgattctgattcaggtaagtcagagactcgtgtccaaaacggtcggtcctaa

SEQ ID NO: 71 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADGKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 72 - DNA, 1521 bp, Brassica napus
atgacgtccattaacgtaaagctcctttaccattacgtcataaccaaccttttcaacctttgtttctttccattaacggcgatcgtcgccggaaaagcctatcggcttaccatagacgatcttcaccacttatactattcctatctccaacacaacctcataaccattgctccactctttgccttcaccgttttcggttcggttctctacatcgcaacccggcccaaaccggtttacctcgttgagtactcatgctaccttccaccaacgcattgtagatcaagtatctccaaggtcatggatatcttttaccaagtaagaaaagctgatccttctcggaacggcacgtgcgatgactcgtcctggcttgacttcttgaggaagattcaagaacgttcaggtctaggcgatgaaacccacgggcccgaggggctgcttcaggtccctccccggaagacttttgcggcggcgcgtgaagagacggagcaagttatcattggtgcgctagaaaatctattcaagaacaccaatgttaaccctaaagatataggtatacttgtggtgaactcaagcatgtttaatccaactccttcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctctccaacaagcctagagatcgtagacggtccaagtacgagctagttcacacggttcgaacgcataccggagctgacgacaagtcttttcgttgcgtgcaacaaggagacgatgagaacggcaaaaccggagtgagtttgtccaaggacataaccgatgttgctggtcgaacggttaagaaaaacatagcaacgctgggtccgttgattcttccgttaagcgagaaacttctttttttcgttaccttcatgggcaagaaacttttcaaagacaaaatcaaacattattacgtcccggacttcaagcttgctatcgaccatttttgtatacatgccggaggcaaagccgtgattgatgtgctagagaagaacctaggcctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcaacaaatagtccttgggaacactgcatcgacagatacccggttaaaattgattctgattcaggtaagtcagagactcgtgtccaaaacggtcggtcctaa

SEQ ID NO: 73 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 74 - DNA, 1521 bp, Brassica napus
atgacgtccattaacgtaaagctcctttaccattacgtcataaccaaccttttcaacctttgcttctttccgttaacggcgatcgtcgccggaaaagcctatcggcttaccatagacgatcttcaccacttatactattcctatctccaacacaacctcataaccatcgctccactctttgccttcaccgttttcggttcggttctctacatcgcaacccggcccaaaccggtttacctcgttgagtactcatgctaccttccaccaacgcattgtagatcaagtatctccaaggtcatggatatcttttatcaagtaagaaaagctgatccttctcggaacggcacgtgcgatgactcgtcgtggcttgacttcttgaggaagattcaagaacgttcaggtctaggcgatgaaactcacgggcccgaggggctgcttcaggtccctccccggaagacttttgcggcggcgcgtgaagagacggagcaagttatcattggtgcgctagaaaatctattcaagaacaccaacgttaaccctaaagatataggtatacttgtggtgaactcaagcatgtttaatccaactccatcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctcttcaacaagcctggagatcgtagacggtccaagtacgagctagttcacacggttcgaacgcatgccggagctgacgacaagtcttttcgttgcgtgcaacaaggagacgatgagaacggcaaaatcggagtgagtttgtccaaggacataaccgatgttgctggtcgaacggttaagaaaaacatagcaacgttgggtccgttgattcttccgttaagcgagaaacttctttttttcgttaccttcatgggcaagaaacttttcaaagataaaatcaaacattactacgtcccggatttcaaacttgctattgaccatttttgtatacatgccggaggcagagccgtgattgatgtgctagagaagaacctagccctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcgacaaatagtccttgggaacactgcatcgacagatacccggtcaaaattgattctgattcaggtaagtcagagactcgtgcccaaaacggtcggtcctaa

SEQ ID NO: 75 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLFNKPGDRRRSKYELVHTVRTHAGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRAQNGRS

SEQ ID NO: 76 - DNA, 1521 bp, Brassica napus
atgacgtccattaacgtaaagctcctttaccattacgtcataaccaaccttttcaacctttgtttctttccattaacggcgatcgtcgccggaaaagcctatcggcttaccatagacgatcttcaccacttatactattcctatctccaacacaacctcataaccattgctccactctttgccttcaccgttttcggttcggttctctacatcgcaacccggcccaaaccggtttacctcgttgagtactcatgctaccttccaccaacgcattgtagatcaagtatctccaaggtcatggatatcttttaccaagtaagaaaagctgatccttctcggaacggcacgtgcaatgactcgtcctggcttgacttcttgaggaagattcaagaacgttcaggtctaggcgatgaaacccacgggcccgaggggctgcttcaggtccctccccggaagacttttgcggcggcgcgtgaagagacggagcaagttatcattggtgcgctagaaaatctattcaagaacaccaatgttaaccctaaagatataggtatacttgtggtgaactcaagcatgtttaatccaactccttcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctctccaacaagcctagagatcgtagacggtccaagtacgagctagttcacacggttcgaacgcataccggagctgacgacaagtcttttcgttgcgtgcaacaaggagacgatgagaacggcaaaaccggagtgagtttgtccaaggacataaccgatgttgctggtcgaacggttaagaaaaacatagcaacgctgggtccgttgattcttccgttaagcgagaaacttctttttttcgttaccttcatgggcaagaaacttttcaaagacaaaatcaaacattattacgtcccggacttcaagcttgctatcgaccatttttgtatacatgccggaggcaaagccgtgattgatgtgctagagaagaacctaggcctagcaccgatcgatgtagaggcatcaagatcaacgttacatagatttggaaacacttcatctagctcaatatggtatgagttggcatacatagaagcaaaaggaaggatgaagaaaggtaataaagtttggcagattgctttagggtcaggctttaagtgtaacagtgcagtttgggtggctctaaacaatgtcaaagcttcaacaaatagtccttgggaacactgcatcgagagatacccggttaaaattgattctgattcaggtaagtcagagactcgtgcccaaaacggtcggtcctaa

SEQ ID NO: 77 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCNDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNSPWEHCIERYPVKIDSDSGKSETRAQNGRS

SEQ ID NO: 78 - DNA, 1518 bp, Brassica napus
atgacgtccattaacgtaaagctcctttaccattacgtcataaccaaccttttcaacctttgtttctttccattaacggcgatcgtcgccggaaaagcctatcttaccatagacgatcttcaccacttatactattcctatctccaacacaacctcataaccattgctccactcttggccttcaccgttttcggttcggttctctacatcgcaacccggcccaaaccggtttacctcgtggagtactcatgctaccttccaccaacgcattgtagatcaagtatctccaaggtcatggatatctttttccaagtaagaaaagctgatccttctcggaacggcacgtgcgatgactcgtcctggcttgacttcttgaggaagattcaagaacgttcaggtctaggcgatgaaacccacgggcccgaggggctgcttcaggtccctccccggaagacttttgcgcgcgcgcgtgaagagacggagcaagttatcattggtgcgctagaaaatctattcaagaacaccaatgttaaccctaaagatataggtatacttgtggtgaactcaagcatgtttaatccaactccttcgctctccgcgatggtcgttaacactttcaagctccgaagcaacgtaagaagctttaaccttggtggcatgggttgtagtgccggcgttatagccattgatctagcaaaggacttgttgcatgtccataaaaatacgtatgctcttgtggtgagcacagagaacatcacttataacatttacgctggtgataataggtccatgatggtttcaaattgcttgttccgtgttggtggggccgctattttgctctccaacaagcctagagatcgtagacggtccaagtacgagctagttcacacggttcgaacgcataccggagctgacgacaagtcttttcgttgcgtgcaacaaggagacgatgagaacggccaaaccggagtgagtttgtccaaggacataaccgatgttgctggtcgaacggttaagaaaaacatagcaacgctgggtccgttgattcttccgttaagcgagaaacttctttttttcgttaccttcatgggcaagaaacttttcaaagacgaaatcaaacattattacgtcccggacttcaagcttgctatcgaccatttttgtatacatgccggaggcaaagccgtgattgatgtgctagagaagaacctaggcctagcaccgatcgatgtagaggcatcaagatcaacgttacatagatttggaaacacttcatctagctcaatatggtatgagttggcatacatagaacccaaaggaaggatgaagaaaggtaataaagtttggcagattgctttagggtcaggctttaagtgtaacagtgcagtttgggtggctctaaacaatgtcaaagcttcaacaaatagtccttgggaacactgcatcgacagatacccggttaaaattgattctgattcaggtaagtcagagactcgtgtcccaaacggtcggtcctaa

SEQ ID NO: 79 - protein, 505 aa, Brassica napus
MTSINVKLLYHYVITNLFNLCFFPLTAIVAGKAYLTIDDLHHLYYSYLQHNLITIAPLLAFTVFGSVLYIATRPKPVYLVEYSCYLPPTHCRSSISKVMDIFFQVRKADPSRNGTCDDSSWLDFLRKIQERSGLGDETHGPEGLLQVPPRKTFARAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGQTGVSLSKDITDVAGRTVKKNIATLGPLILPLSEKLLFFVTFMGKKLFKDEIKHYYVPDFKLAIDHFCIHAGGKAVIDVLEKNLGLAPIDVEASRSTLHRFGNTSSSSIWYELAYIEPKGRMKKGNKVWQIALGSGFKCNSAVWVALNNVKASTNSPWEHCIDRYPVKIDSDSGKSETRVPNGRS

SEQ ID NO: 80 - DNA, 21 bp, artificial sequence
  amiRNA
taagggacgaggaggaaggaa

SEQ ID NO: 81 - DNA, 21 bp, artificial sequence
  STARsequence
ttccttcctcccagtcccttt

SEQ ID NO: 82 - DNA, 21 bp, artificial sequence
  STARsequence
ttcattcctcctcgtccctta

SEQ ID NO: 83 - DNA, 21 bp, artificial sequence
  amiRNA
tttcttgtcaccttccctgtc

SEQ ID NO: 84 - DNA, 21 bp, artificial sequence
  STARsequence
gacagggaaggacacaagaat

SEQ ID NO: 85 - DNA, 21 bp, artificial sequence
  STARsequence
gactgggaaggtgacaagaaa

SEQ ID NO: 86 - DNA, 21 bp, artificial sequence
  amiRNA
tggggaagaaatggcaagcga

SEQ ID NO: 87 - DNA, 21 bp, artificial sequence
  STARsequence
tcgcttgccataacttcccct

SEQ ID NO: 88 - DNA, 21 bp, artificial sequence
  STARsequence
tcgattgccatttcttcccca

SEQ ID NO: 89 - DNA, 21 bp, artificial sequence
  STARsequence
ttgttgttaatcctccacgta

SEQ ID NO: 90 - DNA, 21 bp, artificial sequence
  STARsequence
tacgtggaggaacaacaacat

SEQ ID NO: 91 - DNA, 21 bp, artificial sequence
  STARsequence
tacctggaggattaacaacaa

SEQ ID NO: 92 - DNA, 21 bp, artificial sequence
  amiRNA
tttcttaatacttgcgaccaa

SEQ ID NO: 93 - DNA, 21 bp, artificial sequence
  STARsequence
ttggtcgcaagatttaagaat

SEQ ID NO: 94 - DNA, 21 bp, artificial sequence
  STARsequence
ttgctcgcaagtattaagaaa

SEQ ID NO: 95 - DNA, 21 bp, artificial sequence
  amiRNA
tccctttcttcattcttccct

SEQ ID NO: 96 - DNA, 21 bp, artificial sequence
  STARsequence
agggaagaatgtcgaaagggt

SEQ ID NO: 97 - DNA, 21 bp, artificial sequence
  STARsequence
aggcaagaatgaagaaaggga

SEQ ID NO: 98 - DNA, 21 bp, artificial sequence
  STARsequence
tacacttaaaccctgatccta

SEQ ID NO: 99 - DNA, 21 bp, artificial sequence
  STARsequence
aagacgatgagtccggcaaat

SEQ ID NO: 100 - DNA, 21 bp, artificial sequence
  STARsequence
tagcatcagggtttaagtgta

SEQ ID NO: 101 - DNA, 21 bp, artificial sequence
  STARsequence
ttttgccgctctcatcgtctt

SEQ ID NO: 102 - DNA, 21 bp, artificial sequence
  STARsequence
aagacgatgagtccggcaaat

SEQ ID NO: 103 - DNA, 21 bp, artificial sequence
  STARsequence
aagtcgatgagagcggcaaaa

SEQ ID NO: 104 - DNA, 11042 bp, artificial sequence
  vector
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtgtttaaacggagctccttgaagtccaattgaggatcttactgggtgaattgagctgcttagctatggatcccacagttctacccatcaataagtgcttttgtggtagtcttgtggcttccatatctggggagcttcatttgcctttatagtattaaccttctttggattgaagggagctctagtttaaaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 105 - DNA, 10651 bp, artificial sequence
  vector
  misc_feature (2349)..(2349): n is a, c, g, or t
  misc_feature (10606)..(10608): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgggccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctgtttaaaccacagctttcttgaacttcttatgcatcttatatctctccacctccaggattttaagccctagaagctcaagaaagctgtgggagtttaaactatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacatannnatctcttaatctagagattttatggctttgttatatataaggc

SEQ ID NO: 106 - DNA, 7640 bp, artificial sequence
  vector
  misc_feature (6424)..(6426): n is a, c, g, or t
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctgtttaaaccacagctttcttgaacttcttatgcatcttatatctctccacctccaggattttaagccctagaagctcaagaaagctgtgggagtttaaactatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacatannnatctcttaatctagagattttatggctttgttatatataaggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttg

SEQ ID NO: 107 - DNA, 8031 bp, artificial sequence
  vector
agcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtgtttaaacggagctccttgaagtccaattgaggatcttactgggtgaattgagctgcttagctatggatcccacagttctacccatcaataagtgcttttgtggtagtcttgtggcttccatatctggggagcttcatttgcctttatagtattaaccttctttggattgaagggagctctagtttaaaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaca

SEQ ID NO: 108 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 109 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 110 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtcgcttgccataacttccccttgaggatcttactgggtgaattgagctgcttagctatggatcccacagttctacccatcaataagtgcttttgtggtagtcttgtggcttccatatctggggagcttcatttgcctttatagtattaaccttctggggaagaaatggcaagcgacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 111 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttaagggacgaggaggaaggaacttatgcatcttatatctctccacctccaggattttaagccctagttcattcctcctcgtcccttagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 112 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttgtcaccttccctgtccttatgcatcttatatctctccacctccaggattttaagccctaggactgggaaggtgacaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 113 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttggggaagaaatggcaagcgacttatgcatcttatatctctccacctccaggattttaagccctagtcgattgccatttcttccccagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 114 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtacgtggaggaacaacaacattgaggatcttactgggtgaattgagctgcttagctatggatcccacagttctacccatcaataagtgcttttgtggtagtcttgtggcttccatatctggggagcttcatttgcctttatagtattaaccttcttgttgttaatcctccacgtacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 115 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagttggtcgcaagatttaagaattgaggatcttactgggtgaattgagctgcttagctatggatcccacagttctacccatcaataagtgcttttgtggtagtcttgtggcttccatatctggggagcttcatttgcctttatagtattaaccttctttcttaatacttgcgaccaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 116 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttgttgttaatcctccacgtacttatgcatcttatatctctccacctccaggattttaagccctagtacctggaggattaacaacaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 117 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 118 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 119 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagtaggatcagggactaagtgtttgaggatcttactgggtgaattgagctgcttagctatggatcccacagttctacccatcaataagtgcttttgtggtagtcttgtggcttccatatctggggagcttcatttgcctttatagtattaaccttctacacttaaaccctgatcctacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 120 - DNA, 16042 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttctagctagctagggtttgggtagtgagtgtaataaagttgcaaagtttttggttaggttacgttttgaccttattattatagttcaaagggaaacattaattaaaggggattatgaagaagacgatgagtccggcaaattgaggatcttactgggtgaattgagctgcttagctatggatcccacagttctacccatcaataagtgcttttgtggtagtcttgtggcttccatatctggggagcttcatttgcctttatagtattaaccttcttttgccgctctcatcgtcttcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 121 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttccctttcttcattcttccctcttatgcatcttatatctctccacctccaggattttaagccctagaggcaagaatgaagaaagggagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 122 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttacacttaaaccctgatcctacttatgcatcttatatctctccacctccaggattttaagccctagtagcatcagggtttaagtgtagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 123 - DNA, 15657 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttttgccgctctcatcgtcttcttatgcatcttatatctctccacctccaggattttaagccctagaagtcgatgagagcggcaaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 124 - DNA, 964 bp, artificial sequence
  amiRNA precursor
ggccgcttctagctagctagggtttgggtagtgagtgtaataaagttgcaaagtttttggttaggttacgttttgaccttattattatagttcaaagggaaacattaattaagggattatgaagttcctcaacccaattccctcttgaggatcttactgggtgaattgagctgcttagctatggatcccacagttctacccatcaataagtgcttttgtggtagtcttgtggcttccatatctggggagcttcatttgcctttatagtattaaccttctgagggaaaagggttgaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 125 - DNA, 620 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcgcaagggcgaattctgcagatatccatcacactggc

SEQ ID NO: 126 - DNA, 958 bp, artificial sequence
  amiRNAprecursor
ttctagctagctagggtttgggtagtgagtgtaataaagttgcaaagtttttggttaggttacgttttgaccttattattatagttcaaagggaaacattaattaaaggggattatgaagaagagagtgtacctatgtggttgaggatcttactgggtgaattgagctgcttagctatggatcccacagttctacccatcaataagtgcttttgtggtagtcttgtggcttccatatctggggagcttcatttgcctttatagtattaaccttctccacataaatacactctcttcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatct

SEQ ID NO: 127 - DNA, 1576 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcagttttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccaattctgcagatatccatcacactgaagcttttctagctagctagggtttgggtagtgagtgtaataaagttgcaaagtttttggttaggttacgttttgaccttattattatagttcaaagggaaacattaattaaaggggattatgaagaagagagtgtacctatgtggttgaggatcttactgggtgaattgagctgcttagctatggatcccacagttctacccatcaataagtgcttttgtggtagtcttgtggcttccatatctggggagcttcatttgcctttatagtattaaccttctccacataaatacactctcttcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 128 - DNA, 573 bp, artificial sequence
  amiRNAprecursor
gcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttagccatgtcaaccctcccacttatgcatcttatatctctccacctccaggattttaagccctagtggaagggttgacatggctaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataa

SEQ ID NO: 129 - DNA, 1191 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcagttttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccaattctgcagatatccatcacactgggatccgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttagccatgtcaaccctcccacttatgcatcttatatctctccacctccaggattttaagccctagtggaagggttgacatggctaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 130 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 131 - DNA, 977 bp, artificial sequence
  amiRNAprecursor
ggccgcgaattcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctaagcttgc

SEQ ID NO: 132 - DNA, 1940 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggcccaagc

SEQ ID NO: 133 - DNA, 1940 bp, artifial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctggggcccaagc

SEQ ID NO: 134 - DNA, 2893 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagttcctcaacccaattccctcttgaggatcttactgggtgaattgagctgcttagctatggatcccacagttctacccatcaataagtgcttttgtggtagtcttgtggcttccatatctggggagcttcatttgcctttatagtattaaccttctgagggaaaagggttgaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgaattcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctaagcttttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 135 - DNA, 2559 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttgagggaaaagggttgaggaacttatgcatcttatatctctccacctccaggattttaagccctagttactcaacccttttccctcagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcgcaagggcgaattctgcagatatccatcacacttgggccgcttctagctagctagggtttgggtagtgagtgtaataaagttgcaaagtttttggttaggttacgttttgaccttattattatagttcaaagggaaacattaattaaaggggattatgaaggtggatgatgcctgattggattgaggatcttactgggtgaattgagctgcttagctatggatcccacagttctacccatcaataagtgcttttgtggtagtcttgtggcttccatatctggggagcttcatttgcctttatagtattaaccttcttccaatccagcatcatccaccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgatttttggattgttggatttttataaacaaatctggggccgcttctagctagctagggtttgggtagtgagtgtaataaagttgcaaagtttttggttaggttacgttttgaccttattattatagttcaaagggaaacattaattaaaggggattatgaagtgggctctcttgattcttggatgaggatcttactgggtgaattgagctgcttagctatggatcccacagttctacccatcaataagtgcttttgtggtagtcttgtggcttccatatctggggagcttcatttgcctttatagtattaaccttctccaagaacaaagagagcccacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctggggcccaagc

SEQ ID NO: 136 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 137 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 138 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagtcgcttgccataacttccccttgaggatcttactgggtgaattgagctgcttagctatggatcccacagttctacccatcaataagtgcttttgtggtagtcttgtggcttccatatctggggagcttcatttgcctttatagtattaaccttctggggaagaaatggcaagcgacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 139 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttaagggacgaggaggaaggaacttatgcatcttatatctctccacctccaggattttaagccctagttcattcctcctcgtcccttagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 140 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttgtcaccttccctgtccttatgcatcttatatctctccacctccaggattttaagccctaggactgggaaggtgacaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 141 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttggggaagaaatggcaagcgacttatgcatcttatatctctccacctccaggattttaagccctagtcgattgccatttcttccccagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 142 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagtacgtggaggaacaacaacattgaggatcttactgggtgaattgagctgcttagctatggatcccacagttctacccatcaataagtgcttttgtggtagtcttgtggcttccatatctggggagcttcatttgcctttatagtattaaccttcttgttgttaatcctccacgtacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 143 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagttggtcgcaagatttaagaattgaggatcttactgggtgaattgagctgcttagctatggatcccacagttctacccatcaataagtgcttttgtggtagtcttgtggcttccatatctggggagcttcatttgcctttatagtattaaccttctttcttaatacttgcgaccaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 144 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttgttgttaatcctccacgtacttatgcatcttatatctctccacctccaggattttaagccctagtacctggaggattaacaacaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 145 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 146 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 147 - DNA, 966 bp, artificial sequence
  amiRNAprecursor
ggccgcttctagctagctagggtttgggtagtgagtgtaataaagttgcaaagtttttggttaggttacgttttgaccttattattatagttcaaagggaaacattaattaaaggggattatgaagtaggatcagggactaagtgtttgaggatcttactgggtgaattgagctgcttagctatggatcccacagttctacccatcaataagtgcttttgtggtagtcttgtggcttccatatctggggagcttcatttgcctttatagtattaaccttctacacttaaaccctgatcctacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 148 - DNA, 1157 bp, artificial sequence
  amiRNA precursor
ggccgcttctagctagctagggtttgggtagtgagtgtaataaagttgcaaagtttttggttaggttacgttttgaccttattattatagttcaaagggaaacattaattaaaggggattatgaagaagacgatgagtccggcaaattgaggatcttactgggtgaattgagctgcttagggccgcttctagctagctagggtttgggtagtgagtgtaataaagttgcaaagtttttggttaggttacgttttgaccttattattatagttcaaagggaaacattaattaaaggggattatgaagaagacgatgagtccggcaaattgaggatcttactgggtgaattgagctgcttagctatggatcccacagttctacccatcaataagtgcttttgtggtagtcttgtggcttccatatctggggagcttcatttgcctttatagtattaaccttcttttgccgctctcatcgtcttcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcaacaaatctgc

SEQ ID NO: 149 - DNA, 581 bp, artificial sequence
  amiRNA precursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttccctttcttcattcttccctcttatgcatcttatatctctccacctccaggattttaagccctagaggcaagaatgaagaaagggagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 150 - DNA, 581 bp, artificial sequence
  amiRNAprecursor
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttacacttaaaccctgatcctacttatgcatcttatatctctccacctccaggattttaagccctagtagcatcagggtttaagtgtagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 151 - DNA, 958 bp, artificial sequence
  amiRNAprecursor
ttctagctagctagggtttgggtagtgagtgtaataaagttgcaaagtttttggttaggttacgttttgaccttattattatagttcaaagggaaacattaattaaaggggattatgaagtggagctccttgaagtccaattgaggatcttactgggtgaattgagctgcttagctatggatcccacagttctacccatcaataagtgcttttgtggtagtcttgtggcttccatatctggggagcttcatttgcctttatagtattaaccttctttggattgaagggagctctacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatct

SEQ ID NO: 152 - DNA, 958 bp, artificial sequence; identical to SEQ ID NO: 151
  amiRNAprecursor

SEQ ID NO: 153 - DNA, 574 bp, artificial sequence
  amiRNA precursor
gcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgcttttccacagctttcttgaacttcttatgcatcttatatctctccacctccaggattttaagccctagaagctcaagaaagctgtgggagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataag

SEQ ID NO: 154 - DNA, 1556 bp, artificial sequence
  amiRNA
ggccgcttgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagc

SEQ ID NO: 155 - DNA, 16632 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 156 - DNA, 1556 bp, artificial sequence; identical to SEQ ID NO: 154
  amiRNA

SEQ ID NO: 157 - DNA, 16632 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 158 - DNA, 1556 bp, artificial sequence
  amiRNA
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagc

SEQ ID NO: 159 - DNA, 16632 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 160 - DNA, 1556 bp, artificial sequence
  amiRNA
ggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagc

SEQ ID NO: 161 - DNA, 16632 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 162 - DNA, 2530 bp, artificial sequence
  amiRNA
ggccgcttgggccgcttgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 163 - DNA, 17606 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 164 - DNA, 2530 bp, artificial sequence
  amiRNA
ggccgcttgggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 165 - DNA, 17606 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 166 - DNA, 2530 bp, artificial sequence
  amiRNA
ggccgcttgggccgcttgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 167 - DNA, 17606 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 168 - DNA, 2530 bp, artificial sequence
  amiRNAprecursor
ggccgcttgggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgc

SEQ ID NO: 169 - DNA, 17606 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacgg

SEQ ID NO: 170 - DNA, 19148 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtactttctagacgtacgagatccgcccatccggccggccagatcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcttgggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggagatccaagcttgg

SEQ ID NO: 171 - DNA, 19148 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcttgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccagcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtactttctagacgtacgagatccgcccatccggccggccagatcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcttgggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggagatccaagcttgg

SEQ ID NO: 172 - DNA, 19148 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaagttccttcctcccagtcccttttgaggatcttactgggtgaattgagctgcttagctatggatcccacagttctacccatcaataagtgcttttgtggtagtcttgtggcttccatatctggggagcttcatttgcctttatagtattaaccttctaagggacgaggaggaaggaacacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtactttctagacgtacgagatccgcccatccggccggccagatcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcttgggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggagatccaagcttgg

SEQ ID NO: 173 - DNA, 19148 bp, artificial sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgcgagaaactttgtatgggcatggttatttctcacttctcaccctcctttactttcttatgctaaatcctccttcccctatatctccaccctcaacccctttttctcattataacttttggtgcctagatggtgtgtgtgtgtgcgcgcgagagatctgagctcaattttcctctctcaagtcctggtcatgctttttcttaatacttgcgaccaacttatgcatcttatatctctccacctccaggattttaagccctagttgctcgcaagtattaagaaagaatatggcaattcaggcttttaattgctttcatttggtaccatcacttgcaagatttcagagtacaaggtgaacacacacatcttcctcttcatcaattctctagtttcatccttatcttttcattcacggtaactctcactaccctctttcatcttataagttataccgggggtgtgatgttgatgagtgtaaattaaatatatgtgatctctttctctggaaaaattttcagtgtgatatacataataatctcttaatctagagattttatggctttgttatatataatgggccgcttctagctagctagggtttgggtagtgagtgtaataaagttgcaaagtttttggttaggttacgttttgaccttattattatagttcaaagggaaacattaattaaaggggattatgaaggacagggaaggacacaagaattgaggatcttactgggtgaattgagctgcttagctatggatcccacagttctacccatcaataagtgcttttgtggtagtcttgtggcttccatatctggggagcttcatttgcctttatagtattaaccttctttcttgtcaccttccctgtccacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggcccaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtactttctagacgtacgagatccgcccatccggccggccagatcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcttgggcccttctagctagctagggtttgggtagtgagtgtaataaagttgcaaagtttttggttaggttacgttttgaccttattattatagttcaaagggaaacattaattaaaggggattatgaagagggaagaatgtcgaaagggttgaggatcttactgggtgaattgagctgcttagctatggatcccacagttctacccatcaataagtgcttttgtggtagtcttgtggcttccatatctggggagcttcatttgcctttatagtattaaccttctccctttcttcattcttccctcacccttctcttcttttctctcataataatttaaatttgttatagactctaaactttaaatgttttttttgaagtttttccgtttttctcttttgccatgatcccgttcttgctgtggagtaaccttgtccgaggtatgtgcatgattagatccatacttaatttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttactcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggataatttttgtttgaaataatatggtaatgtcttgtctaaatttgtgtacataattcttactgattttttggattgttggatttttataaacaaatctgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggagatccaagcttgg

SEQ ID NO: 174 - DNA, 1155 bp, Brassica carinata
atgggtgcaggtggaagaatgcaggtttctccttctcccaagaagtccgaaaccgataccatcaagcgtgttccctgcgagacgcctcccttcacagtaggagagctcaagaaagccatcccaccgcactgtttcaaacgctccatccctcgctctttctcctacctcatctgggacatcatcgtagcctcctgcttctactacgtcgccaccacctacttccccctcctccctcaccctctctcttacattgcttggcctctctactgggcctgccaaggctgcgtcctaaccggcgtctgggtcatagcccacgaatgcggccaccacgctttcagcgactaccagtggctagacgacaccgtcggtctcatcttccattccttcctcctcgtcccttacttctcctggaagtacagccatcgccgtcaccactccaacaccggttcgctcgagagagacgaggtgtttgtccccaagaaaaaatcagacatcaagtggtacggcaagtacctcaacaaccctctcggacgcaccgtgatgctaaccgtccagttcactctcggctggcccttgtacttggccttcaacgtctcgggcagaccttaccccgaggggttcgcctgccatttccacccgaacgctcccatctacaacgaccgtgaacgcctccagatatacgtctccgacgctggcatcctcgccgtctgctacggtctctaccgttacgctgccgcgcagggagtggcctcgatggtctgcctctacggagttccgcttctgatagtcaacgcgttcctcgtcttgatcacttacttgcagcacacgcatccttcgctgcctcactacgactcctctgagtgggattggttgaggggagcgttggccactgttgacagagactacggaatcttgaacaaggtcttccacaacatcacggacacgcacgtggcgcatcatctgttctccacgatgccgcattatcacgcgatggaggctacgaaggcgataaagccgattctgggagactattaccagttcgatgggacaccatgggttaaggcgatgtggagggaggcgaaggagtgtatctatgttgaaccggacaggcaaggtgagaagaaaggtgtgttctggtacaacaataagttatga

SEQ ID NO: 175 - protein, 384 aa, Brassica carinata
MGAGGRMQVSPSPKKSETDTIKRVPCETPPFTVGELKKAIPPHCFKRSIPRSFSYLIWDIIVASCFYYVATTYFPLLPHPLSYIAWPLYWACQGCVLTGVWVIAHECGHHAFSDYQWLDDTVGLIFHSFLLVPYFSWKYSHRRHHSNTGSLERDEVFVPKKKSDIKWYGKYLNNPLGRTVMLTVQFTLGWPLYLAFNVSGRPYPEGFACHFHPNAPIYNDRERLQIYVSDAGILAVCYGLYRYAAAQGVASMVCLYGVPLLIVNAFLVLITYLQHTHPSLPHYDSSEWDWLRGALATVDRDYGILNKVFHNITDTHVAHHLFSTMPHYHAMEATKAIKPILGDYYQFDGTPWVKAMWREAKECIYVEPDRQGEKKGVFWYNNKL

What is claimed:

1. An isolated polynucleotide comprising a sequence encoding at least one artificial microRNA precursor, operably linked to at least one regulatory polynucleotide, wherein upon transcription of the sequence a transcript comprising the artificial miRNA precursor is produced, wherein processing of the transcript excises a mature miRNA about 21 to 22 nucleotides in length from the artificial miRNA precursor, the mature miRNA inhibiting expression of fad3, and wherein the at least one artificial microRNA precursor comprises SEQ ID NO: 130.

2. A recombinant construct comprising the isolated polynucleotide of claim 1 operably linked to at least one heterologous regulatory sequence.

3. A plant cell comprising the recombinant construct of claim 2.

4. The plant cell of claim 3 wherein the plant cell is a dicot plant cell.

5. A method for reducing expression at least one plant fatty acid biosynthetic gene, the method comprising transforming a plant cell with at least one isolated nucleic acid sequence comprising a sequence encoding at least one artificial microRNA precursor, operably linked to at least one regulatory sequence, wherein:
  (a) the at least one sequence encoding an artificial microRNA precursor is transcribed to produce a transcript comprising the at least one artificial miRNA precursor;
  (b) the transcript is processed so that at least one mature miRNA about 21 to 22 nts in length is excised from the artificial miRNA precursor; and
  (c) expression of fad3 is reduced;
  and wherein the at least one artificial microRNA precursor comprises SEQ ID NO:130.

6. The method of claim 5 wherein the plant cell is a dicot plant cell.

7. An isolated polynucleotide comprising a sequence encoding two or more artificial microRNA precursors, operably linked to at least one regulatory polynucleotide, the two or more artificial microRNA precursors being on the same or separate transcriptional units, wherein upon transcription of the sequence a transcript comprising the artificial miRNA precursors is produced, and wherein processing of the transcript excises mature miRNAs about 21 to 22 nucleotides in length from the artificial miRNA precursors, the mature miRNAs inhibiting expression of fad3 and at least one fad2 delta-12 desaturase, wherein at least one of said two or more artificial microRNA precursors comprises SEQ ID NO:130.

8. A recombinant construct comprising the isolated polynucleotide of claim 7 operably linked to at least one heterologous regulatory sequence.

9. A plant cell comprising the recombinant construct of claim 8.

10. The plant cell of claim 9 wherein the plant cell is a dicot plant cell.

11. A method for reducing expression of two or more plant fatty acid biosynthetic genes, the method comprising transforming a plant cell with at least one isolated polynucleotide comprising a sequence encoding two or more artificial microRNA precursors, the two or more artificial microRNA precursors being on the same or separate transcriptional units and operably linked to at least one regulatory sequence wherein:
  (a) the at least one sequence encoding two or more artificial microRNA precursors is transcribed to produce at least one transcript comprising the two or more artificial miRNA precursors;
  (b) the at least one transcript is processed so that at least two different mature miRNAs about 21 to 22 nucleotides in length are excised from the artificial miRNA precursors; and
  (c) expression of fad3 and at least one fad2 delta-12 desaturase gene are reduced,
  and wherein at least one of said two or more artificial microRNA precursors comprises SEQ ID NO:130.

12. The method of claim 11 wherein the plant cell is a dicot plant cell.

13. An isolated polynucleotide comprising a sequence encoding at least one artificial microRNA precursor, operably linked to at least one regulatory polynucleotide, wherein the sequence encoding at least one artificial microRNA precursor is capable of forming a double-stranded RNA or hairpin, wherein the at least one artificial microRNA precursor comprises an miRNA sequence and its corresponding complementary STAR sequence, and wherein excision of the miRNA sequence from the artificial microRNA precursor inhibits expression of fad3, and further wherein the at least one artificial microRNA precursor comprises a nucleotide sequence as set forth in SEQ ID NO:130.

14. An isolated polynucleotide comprising a sequence encoding two or more artificial microRNA precursors, operably linked to at least one regulatory polynucleotide, the two or more artificial microRNA precursors being on the same or separate transcriptional units, wherein the sequences encoding two or more artificial microRNA precursors are capable of forming a double-stranded RNA or hairpin, wherein the two or more artificial microRNA precursors comprise two or more miRNA sequences and their corresponding complementary STAR sequences, wherein excision of the miRNA sequences from the two or more artificial microRNA precursors inhibits expression of fad3 and at least one fad2 delta-12 desaturase, and wherein at least one of the two or more artificial microRNA precursors comprises SEQ ID NO:130.

15. The isolated polynucleotide of claim 14, wherein at least one of the two or more miRNA sequences comprises SEQ ID NO: 24.

16. A transgenic plant or seed comprising the polynucleotide of claim 1, 13 or 14.

17. The method according to claim 5, wherein the miRNA sequence comprises SEQ ID NO: 24.

18. The isolated polynucleotide of claim 14, wherein at least one of the two or more amiRNA sequences comprises SEQ ID NO: 24 and another one comprises SEQ ID NO: 21 or 22.

19. The method according to claim 11, wherein at least one of said two or more amiRNA sequences comprises SEQ ID NO: 24 and another one comprises SEQ ID NO: 21.

20. The method according to claim 11, wherein at least one of said two or more amiRNA sequences comprises SEQ ID NO: 24 and another one comprises SEQ ID NO: 22.

* * * * *